(12) United States Patent
Cigan et al.

(10) Patent No.: US 11,560,568 B2
(45) Date of Patent: Jan. 24, 2023

(54) GENERATION OF SITE-SPECIFIC-INTEGRATION SITES FOR COMPLEX TRAIT LOCI IN CORN AND SOYBEAN, AND METHODS OF USE

(71) Applicants: E I DU PONT DE NEMOURS AND COMPANY, Wilmington, DE (US); PIONEER HI-BRED INTERNATIONAL, INC., Johnston, IA (US)

(72) Inventors: Andrew Mark Cigan, Madison, WI (US); Huirong Gao, Johnston, IA (US); Zhan-Bin Liu, West Chester, PA (US); Jasdeep Mutti, Johnston, IA (US); Dean Podlich, Des Moines, IA (US); Christopher Jay Scelonge, Ankeny, IA (US)

(73) Assignees: E. I. DU PONT DE NEMOURS AND COMPANY; PIONEER HI-BRED INTERNATIONAL, INC.

( * ) Notice: Subject to any disclaimer, the term of this patent is extended or adjusted under 35 U.S.C. 154(b) by 303 days.

(21) Appl. No.: 15/510,037

(22) PCT Filed: Aug. 31, 2015

(86) PCT No.: PCT/US2015/047706
§ 371 (c)(1),
(2) Date: Mar. 9, 2017

(87) PCT Pub. No.: WO2016/040030
PCT Pub. Date: Mar. 17, 2016

(65) Prior Publication Data
US 2018/0230476 A1 Aug. 16, 2018

Related U.S. Application Data

(60) Provisional application No. 62/049,465, filed on Sep. 12, 2014.

(51) Int. Cl.
*C12N 15/82* (2006.01)

(52) U.S. Cl.
CPC ...... *C12N 15/8213* (2013.01); *C12N 15/8274* (2013.01); *C12N 15/8279* (2013.01); *C12N 15/8289* (2013.01)

(58) Field of Classification Search
CPC .......................... C12N 15/8213; C12N 15/8201
See application file for complete search history.

(56) References Cited

U.S. PATENT DOCUMENTS

| | | |
|---|---|---|
| 5,036,006 A | 7/1991 | Sanford |
| 5,380,831 A | 1/1995 | Adang et al. |
| 5,436,391 A | 7/1995 | Fujimoto et al. |
| 5,929,301 A | 7/1999 | Baszczynski et al. |
| 5,959,177 A | 9/1999 | Hein |
| 6,187,994 B1 | 2/2001 | Baszczynski et al. |
| 6,967,263 B2 | 11/2005 | Narvel et al. |
| 7,223,601 B2 | 5/2007 | Baszczynski et al. |
| 7,292,055 B2 | 8/2007 | Choo |
| 7,807,868 B2 * | 10/2010 | Baszczynski .......... C12N 15/90 800/278 |
| 8,012,752 B2 | 9/2011 | Jayakumar et al. |
| 8,293,533 B2 * | 10/2012 | Falco ................. C12N 15/8213 435/468 |
| 8,574,910 B2 | 11/2013 | Falco et al. |
| 8,575,424 B2 | 11/2013 | Yau et al. |
| 8,581,036 B2 | 11/2013 | Samboju et al. |
| 8,586,361 B2 | 11/2013 | Tao et al. |
| 8,609,420 B2 | 12/2013 | Samuel et al. |
| 8,653,327 B2 | 2/2014 | Samboju et al. |
| 8,680,366 B2 | 3/2014 | Eudes et al. |
| 8,697,359 B1 | 4/2014 | Zhang |
| 8,722,410 B2 | 5/2014 | Samuel et al. |
| 8,771,945 B1 | 7/2014 | Zhang |
| 8,795,965 B2 | 8/2014 | Zhang |

(Continued)

FOREIGN PATENT DOCUMENTS

| | | |
|---|---|---|
| EP | 0359472 | 3/1990 |
| EP | 0385962 | 9/1990 |

(Continued)

OTHER PUBLICATIONS

Accession NM_001305818 (Year: 2019).*

(Continued)

*Primary Examiner* — Charles Logsdon
*Assistant Examiner* — Wayne Zhong

(57) ABSTRACT

Compositions and methods are provided for introducing transgenic target sites for Site Specific Integration (SSI) and/or polynucleotides of interest into at least one double-strand break target site of a double-strand-break inducing agent in a genomic window of a plant genome. Also provided are methods and compositions for producing a complex trait locus in a genomic window of a plant comprising at least one transgenic target site for site specific integration integrated in at least double-strand-break target site. The double-strand-break target site can be, but is not limited to, a target site for a zinc finger endonuclease, an engineered endonuclease, a meganuclease, a TALENs and/or a Cas endonuclease. The genomic window of said plant can comprise at least one genomic locus of interest such as a trait cassette, a transgene, a mutated gene, a native gene, an edited gene or a site-specific integration (SSI) target site.

25 Claims, 12 Drawing Sheets
Specification includes a Sequence Listing.

(56) References Cited

U.S. PATENT DOCUMENTS

| | | |
|---|---|---|
| 8,802,921 B2 | 8/2014 | Ainley et al. |
| 8,865,406 B2 | 10/2014 | Zhang |
| 8,871,445 B2 | 10/2014 | Cong |
| 8,889,356 B2 | 11/2014 | Zhang |
| 8,889,418 B2 | 11/2014 | Zhang et al. |
| 8,895,308 B1 | 11/2014 | Zhang |
| 8,906,616 B2 | 12/2014 | Zhang |
| 8,932,814 B2 | 1/2015 | Cong |
| 8,945,839 B2 | 2/2015 | Zhang |
| 8,993,233 B2 | 3/2015 | Zhang et al. |
| 8,999,641 B2 | 4/2015 | Zhang et al. |
| 9,163,284 B2 | 10/2015 | Liu |
| 9,187,755 B2 | 11/2015 | Samuel et al. |
| 9,382,548 B2 | 7/2016 | Eudes et al. |
| 9,476,057 B2 | 10/2016 | Samuel et al. |
| 9,493,782 B2 | 11/2016 | Cigan |
| 9,670,496 B2 | 6/2017 | D'Halluin et al. |
| 9,695,432 B2 | 7/2017 | Russell et al. |
| 9,719,108 B2 | 8/2017 | Samuel et al. |
| 9,840,713 B2 | 12/2017 | Zhang |
| 9,885,033 B2 | 2/2018 | Joung |
| 9,909,131 B2 | 3/2018 | Sastry-Dent et al. |
| 10,030,245 B2 | 7/2018 | Lassner et al. |
| 2003/0050258 A1 | 3/2003 | Calos |
| 2004/0231016 A1 | 11/2004 | Wang |
| 2006/0253918 A1 | 11/2006 | Que |
| 2006/0282911 A1 | 12/2006 | Bull |
| 2007/0083945 A1 | 4/2007 | Byrum |
| 2007/0178593 A1 | 8/2007 | Miller |
| 2007/0199095 A1 | 8/2007 | Allen |
| 2008/0047031 A1* | 2/2008 | Tao ............... C12N 15/102 800/278 |
| 2009/0104700 A1 | 4/2009 | Samuel et al. |
| 2009/0133152 A1 | 5/2009 | Lyznik |
| 2010/0076057 A1 | 3/2010 | Sontheimer |
| 2010/0100980 A1 | 4/2010 | Bull |
| 2010/0159598 A1 | 6/2010 | Jayakumar et al. |
| 2010/0311168 A1 | 12/2010 | Samuel et al. |
| 2010/0313293 A1 | 12/2010 | Albertsen et al. |
| 2011/0035836 A1 | 2/2011 | Eudes et al. |
| 2011/0047655 A1 | 2/2011 | Tao |
| 2011/0165679 A1 | 7/2011 | Gordon-Kamm |
| 2011/0189775 A1 | 8/2011 | Ainley et al. |
| 2011/0191877 A1 | 8/2011 | Russell et al. |
| 2011/0191899 A1 | 8/2011 | Ainley et al. |
| 2011/0203012 A1 | 8/2011 | Dotson et al. |
| 2011/0247100 A1 | 10/2011 | Samboju et al. |
| 2012/0023619 A1 | 1/2012 | Samboju et al. |
| 2012/0023620 A1 | 1/2012 | Yau et al. |
| 2012/0047609 A1 | 2/2012 | Yu et al. |
| 2012/0244569 A1 | 9/2012 | Samuel et al. |
| 2013/0157369 A1 | 6/2013 | Miller |
| 2013/0198888 A1 | 8/2013 | Falco et al. |
| 2013/0263324 A1 | 10/2013 | Lassner |
| 2013/0326645 A1* | 12/2013 | Cost ............... C12N 15/8274 435/468 |
| 2014/0020131 A1 | 1/2014 | Bidney |
| 2014/0068797 A1 | 3/2014 | Doudna |
| 2014/0090113 A1 | 3/2014 | Cogan et al. |
| 2014/0096284 A1 | 4/2014 | Martin-Ortigosa et al. |
| 2014/0179006 A1 | 6/2014 | Zhang |
| 2014/0179770 A1 | 6/2014 | Zhang |
| 2014/0182012 A1 | 6/2014 | Eudes et al. |
| 2014/0186843 A1 | 7/2014 | Zhang |
| 2014/0186919 A1 | 7/2014 | Zhang |
| 2014/0186958 A1 | 7/2014 | Zhang |
| 2014/0189896 A1 | 7/2014 | Zhang |
| 2014/0196169 A1 | 7/2014 | D'Halluin et al. |
| 2014/0227787 A1 | 8/2014 | Zhang |
| 2014/0234972 A1 | 8/2014 | Zhang |
| 2014/0242664 A1 | 8/2014 | Zhang |
| 2014/0242699 A1 | 8/2014 | Zhang |
| 2014/0242700 A1 | 8/2014 | Zhang |
| 2014/0242702 A1 | 8/2014 | Chen |
| 2014/0242703 A1 | 8/2014 | Samuel et al. |
| 2014/0248702 A1 | 9/2014 | Zhang |
| 2014/0256046 A1 | 9/2014 | Zhang |
| 2014/0273231 A1 | 9/2014 | Zhang et al. |
| 2014/0273232 A1 | 9/2014 | Zhang et al. |
| 2014/0273234 A1 | 9/2014 | Zhang |
| 2014/0273235 A1 | 9/2014 | Voytas |
| 2014/0310830 A1 | 10/2014 | Zhang |
| 2014/0335620 A1 | 11/2014 | Zhang |
| 2014/0342456 A1 | 11/2014 | Mali |
| 2014/0357530 A1 | 12/2014 | Zhang |
| 2014/0370558 A1 | 12/2014 | Mathis |
| 2015/0040267 A1 | 2/2015 | Ainley et al. |
| 2015/0128307 A1 | 5/2015 | Sastry-Dent et al. |
| 2015/0128308 A1 | 5/2015 | Sastry-Dent et al. |
| 2015/0128309 A1 | 5/2015 | Sastry-Dent et al. |
| 2015/0128310 A1 | 5/2015 | Sastry-Dent et al. |
| 2015/0143588 A1 | 5/2015 | Sastry-Dent et al. |
| 2015/0167009 A1 | 6/2015 | D'Halluin |
| 2016/0257967 A1 | 9/2016 | Russell et al. |
| 2016/0272987 A1* | 9/2016 | Gil ............... C12N 15/8241 |
| 2017/0107527 A1 | 4/2017 | Dotson et al. |
| 2018/0010200 A1 | 1/2018 | Sastry-Dent et al. |
| 2018/0142250 A1 | 5/2018 | Sastry-Dent et al. |
| 2018/0258438 A1 | 9/2018 | Chaky et al. |
| 2018/0305706 A1 | 10/2018 | Cigan et al. |

FOREIGN PATENT DOCUMENTS

| | | |
|---|---|---|
| WO | 1991016432 | 10/1991 |
| WO | 1999025821 | 5/1999 |
| WO | 1999025840 | 5/1999 |
| WO | 1999025854 | 5/1999 |
| WO | 1999025855 | 5/1999 |
| WO | 2001011058 | 2/2001 |
| WO | 2005049842 | 6/2005 |
| WO | 2007011733 | 1/2007 |
| WO | 2007025097 | 3/2007 |
| WO | 2007134122 | 11/2007 |
| WO | 2008148559 | 12/2008 |
| WO | 2009006297 | 1/2009 |
| WO | 2009042164 | 4/2009 |
| WO | 2009114321 | 9/2009 |
| WO | 2010011961 | 1/2010 |
| WO | 2010077319 A1 | 7/2010 |
| WO | 2010080430 | 7/2010 |
| WO | 2011117249 | 9/2011 |
| WO | 2011143124 | 11/2011 |
| WO | 2012129373 A2 | 9/2012 |
| WO | 2012164565 | 12/2012 |
| WO | 2013019411 | 2/2013 |
| WO | 2013066423 A2 | 5/2013 |
| WO | 2013068845 | 5/2013 |
| WO | 2013098244 | 7/2013 |
| WO | 2013112686 A1 | 8/2013 |
| WO | 2013141680 | 9/2013 |
| WO | 2013142578 | 9/2013 |
| WO | 2013173535 | 11/2013 |
| WO | 2013176772 | 11/2013 |
| WO | 2014018423 | 1/2014 |
| WO | 2014065596 | 5/2014 |
| WO | 2014071006 | 5/2014 |
| WO | 2014089290 | 6/2014 |
| WO | 2014093479 | 6/2014 |
| WO | 2014093635 | 6/2014 |
| WO | 2014093694 | 6/2014 |
| WO | 2014093712 | 6/2014 |
| WO | 2014093768 A1 | 6/2014 |
| WO | 2014144155 | 9/2014 |
| WO | 2014144761 | 9/2014 |
| WO | 2014150624 | 9/2014 |
| WO | 2014164466 | 10/2014 |
| WO | 2014165825 | 10/2014 |
| WO | 2014186686 | 11/2014 |
| WO | 2014194190 | 12/2014 |
| WO | 2015026883 A1 | 2/2015 |

(56) References Cited

FOREIGN PATENT DOCUMENTS

WO            2015026887 A1     2/2015
WO            2016040030         3/2016

OTHER PUBLICATIONS

Accession XM_008653185 (Year: 2017).*
Abate et al (Characteristics of maize cultivars in Africa: How modern are they and how many do smallholder farmers grow? Abate et al. Agric & Food Secur. 1-17, 2017) (Year: 2017).*
Bashir et al (Expression and enzyme activity of glutathione reductase is upregulated by Fe-deficiency in graminaceous plants. Plant Mol Biol. 65:277-284, 2007) (Year: 2007).*
Wijnker et al (Managing meiotic recombination in plant breeding. Trends in Plant Science. 13: 640-646, 2008) (Year: 2008).*
Bottcher et al (Efficient chromosomal gene modification with CRISPR/cas9 and PCR-based homologous recombination donors in cultured *Drosophila* cells. Nucleic Acids Research, 42: 1-16, 2014) (Year: 2014).*
Houchins et al (Accession BV687137, published Dec. 2006). (Year: 2006).*
Liang et al (Targeted Mutagenesis in *Zea mays* Using TALENs and the CRISPR/Cas System. Journal of Genetics and Genomics 41, 63-68, 2013). (Year: 2013).*
Nelson et al (Methylation-sensitive linking libraries enhance gene-enriched sequencing of complex genomes and map DNA methylation domains. BMC Genomics 9, 621, 2008). (Year: 2008).*
Bottcher et al (Efficient chromosomal gene modification with CRISPR/cas9 and PCR-based homologous recombination donors in cultured *Drosophila* cells. Nucleic Acids Research, 42: 1-16, Apr. 2014). (Year: 2014).*
Djukanovic, et al.; "Male-sterile maize plants produced by the targeted mutageneisis of the cytochrome P450-like gene (MS26) using a redesigned I-CREI homing endonuclease". The Plant Journal 76(5):888-899. 2013.
Liang, et al.; "Targeted mutagenesis in *Zea mays* using TALENs and the CRISPR/Cas system". J Genetic Genomics 41(2):63-68. 2013.
Ainley. et al.; "Trait stacking via targeted genome editing". Plant Biotech J 11(9):1126-1134. 2013.
Svitashev, et al.; "Targeted mutagenesis, precise gene editing, and site-specific gene insertion in maize using Cas9 and guide RNA". Plant Phys 169(2):931-945. 2015.
Que. et al.; "Maize transformation technology development for commercial event generation". Frontiers in Plant Sci 5(5):12-15. 2014.
Shulka, et al.; "Precise genome modification in the crop species *Zea mays* using zinc finger nucleases". Nature 459(7245):437. 2009.
Gaj, et al.; "ZFN, TALEN, and CRISPR/Cas-based methods for genome engineering". Trends in Biotech 31(7):397-405. 2013.
Ganal, et al.; "A large maize (*Zea mays* L.) SNP genotyping array: development and germplasm genotyping and genetic mapping to compare with the B73 reference genome". PLoS One 6(12):e28334. 2011.
Ken Abrembski et al, Bacteriophage P1 Site-specific Recombination, The Journal of Biological Chemistry, Feb. 10, 1984, vol. 259, No. 3, pp. 1509-1514.
Henrik Albert et al, Site-specific integration of DNA into wild-type and mutant lox sites placed in the plant genome. The Plant Journal 1995, vol. 7. No. 4, pp. 649-659.
Alexandra Baer et al, Coping with kinetic and thermodynamic barriers: RMCE, an efficient strategy for the targeted integration of transgenes, Current Opinion in Biotechnology 2001. vol. 12, pp. 473-480.
Banerjee, A., et al., "Markerless Multiple-Gene-Deletion System for *Streptococcus mutans*," Applied and Environmental Microbiology, 2008, vol. 74(7), pp. 2037-2042.
Cai et al., Targeted transgene integration in plant cells using designed zincfinger nucleases, 2009, Plant. Mol. Biol. 69: 699-709.

Rekha Chawla et al, Transgene expression produced by biolistic-mediated, site,pecific gene integration is consistently inherited by the subsequent generations Plant Biotechnology Journal, 2006, vol. 4, pp. 208-218.
Liane Chen et al, Production and characterization of human 293 cell lines expressing the site-specific recmobinase Cre, somatic Cell and Molecular Genetics 1996, vol. 22 No. 6, pp. 477-488.
Civardi et al 1994 Proc Natl Acad Sci USA vol. 91 pp. 8268-8271.
Michael M Cox, The FLP protein of the yeast 2-pm plasmid Expression of a eukaryotic genetic recombmation system in *Esherichia coli*. Jul. 1983, Proc. Natl. Acad. Sci, vol. 80, pp. 4223-4227.
"Christopher D. Day etal, Transgene integration into the same chromosome location can produce alleles that express at a prediclabte level, or alleles that are differentially silenced, Genes & Development, 2000, vol. 14, f)p. 2869-2880."
Vesna Djukanovic et al: "Male-sterile maize plants produced by targeted mutagenesis of the cytochrome P450-ike gene {MS26) using a re-designed I-CreI homing endonuclease", The Plant J, Nov. 5, 2013, vol. 76, pp. 888-899.
Gidoni, D., et al., "Site-specific excisional recombination strategies for elimination of undesirable transgenes from crop plants," In Vitro Cellular Developmental Biology Plant, 2008, vol. 44(6), pp. 457-467.
Gilbertson 2003 Trends in Biotechnology vol. 21 pp. 550-555.
Amy C. Groth et al Phage Integrases: Biology and Applications, J Mol Biol 2004, vol. 335, pp. 667-678.
Feng Guo et al , Structure of Cre recombinase complexed with DNA in a site.specific recombination synapse, Nature. Sep. 4, 1997, vol. 389, pp. 40-46.
Carsten Horn et al, Site-specific genomic:targeting in *Drosophila*, PNAS, Aug. 30, 2005, vol. 102, No. 35, pp. 12483-12488.
Shigeru Iida et al Modification of endogenous natural genes by gene targeting in rice and other higher plants. Plant Molecular Biology, 2005, vol. 59, pp. 205-2·19.
Matthias Lauth et al, Stable and efficient cassette exchange under non-selectable conditions by combined use of two site-specific recombinases, Nucleic Acids Research, 2002. vol. 30, No. 21 e115 pp. 1-7.
Zhongsen Li et al., A Cre-LoxP-mediated self-activating gene excision system to produce marker gene free transgenic soybean plants, Plant Mol. Biol., 2007, pp. 329-341, vol. 65.
Zhongsen Li et al. Site-Specific Integration of Transgenes in Soybean via Recombinase-Mediated DNA Cassette Exchange [OA], Plant Physiology Nov. 2009, vol. 151 pp. 1087-1095.
Li et al: "Stacking Multiple Transgenes at a Selected Genomic Site via Repeated Recombinase-Mediated DNA Cassette Exchanges," Plant Physiology, Oct. 2010, pp. 622-631, vol. 154.
Zhongsen Li et al: "Cas9-Guide RNA Directed Genome Editing in Soybean", Plant Physiol, Aug. 20, 2015, ,01. 169 No. 2, pp. 960-970.
Jeanine D. Louwerse et al.. Stable Recombinase-Mediated Cassette Exchange in *Arabidopsis* Using Agrobacterium tumefaciens, Plant Physiology, Dec. 2007, vol. 145. pp. 1232.-1293.
Leszek A. L Yznik et al., Activity of yeast FLP recomb1nase in maize and rice protoplasts, Nucleic Acids Research, 1993, vol. 21, No. 4, pp. 969-975.
L. Alexander L Yznik et al., Application of Site-Specific Recombination Systems for Targeted modification of Plant Genomes, Transgenic plant journal, 2007, pp. 1-9, vol. 1, No. 1.
Lyznik et al: 2012, In: Transgenic Plants: Methods and Protocols, Methods in Molecular Biology 847: 399-416.
Elizabeth E Murray et al., Codon usage in plant genes, Nucleic Acids Research, 1989, vol. 17, No. 2, pp. 477-498.
Kazuya Nanto et al, Agrobacterium-mediated RMCE approach for gene replacement Plant Biotechnology Journal 2005, vol. 3 pp. 203-214.
David W. Ow, Recombinase-directed plant transformation for the post-genomic era. Plant Molecular Biology, 2002, vol. 48, pp. 183-200.
David Ow et al: "Recombinase-mediated Gene Stacking as a Transformation Operating System", J Integrative Plant Biol, Jun. 15, 2011, vol. 53 No. 7, pp. 512-519.

(56) References Cited

OTHER PUBLICATIONS

Frederick J. Perlak et al. Modification of the coding sequence enhances plant expression of insect control protein genes. Proc. Natl.. Acad. Sci., Apr. 1991. vol. 88, pp. 3324-3328.
Que, Q., et al., "Trait stacking in transgenic crops: challenges and opportunities," GM Crops, 2010, vol. 1(4), pp. 220-229.
Thomas Schlake et al Use of Mltated FLP Recognition Target (FRT) Sites for the Exchange of Expression Cassettes at Defined Chromosomal Loci, Biochemistiy 1994, vol. 33, pp. 12746-12751.
A. . G. Shaikh et al , The Cre recombinase Cleaves the lox Site in trans, The Journal of Biological Chemistry, Feb. 28, 1997, vol. 272, No. 9, pp. 5695-5702.
Shuangyong et al., Generation and identification of rice T-DNA insertional mutant lines, Acta Genetica Sinica vol. 32 No. 12, pp. 1388-1394 (2004) Abstract.
Q Song et al: "Development and evaluation of SoySNP50K, a high density genotyping array for soybean", PLoSONE, Jan. 25, 2015, vol. 8 No. 1, p. e54985.
Vibha Srivastava et al. Biolistic medited site-specific integration in rice, Molecular Breeding, 2001, vol. 8, pp. 345.350.
Vibha Srivastava et al, Cre-mediated site-specific gene integration for consistent transgene expression in rice, Plant Biotechnology Journal, 2004, vol. 2 pp. 169-179.
Vibha Srivastava et al, Marker-free site-specific integration in plants, Trends in Biotechnology, 2004, vol. 22 No. 12, pp. 627-629.
Thomson et al: "Site-Specific Recombination Systems for the Genetic Manipulation of Eukaryotic Genomes" 2006, vol. 44 pp. 465-476.
Townsend et al: "High-frequency modification of plant genes using engineered zinc-finger nucleases," Nature, 2009, vol. 459(7245), pp. 442-446.
K. Ryan Trinh et al, Site-specific and directional gene replacement mediated by Cre recombinase, Journal of Immunological Methods. 2000, vol. 244, pp. 185-193.
Annette C. Vergunst et al, Site-specific integration of Agrobacterium T-DNA in *Arabidopsis thaliana* mediated by Cre recombinase, Nucleic Acids Research, 1998, vol. 26, No. 11, pp. 2729-2734.
Adam T. Watson et al., Gene tagging and gene replacement using recombinase-mediated cassette exchange in Schizosaccharomyces pombe, Gene Elsevier, 2008, pp. 63-74, vol. 407 (and Supplemental).
Wijnker et al (2008 Trends in Plant Science 13:12, p. 640-646).
David A. Wright et al High-frequency homologous recombination in plants mediated by zinc finger nucleases, The Plant Journal, 2006, vol. 44, 693-705, pp. 693-705.
Zeevi et al., 2008, Proc. Natl. Acad. Sci. USA 105: 12785-12790.
The International Search Report and Written Opinion for PCTUS2015047706.
Barrangou et al., CRISPR Provides Acquired Resistance Against Viruses in Prokaryotes, Science, 2007, pp. 1709-1712, vol. 315.
Barrangou et al., RNA-mediated programmable DNA cleavage, Nature Biotechnology, Sep. 2012, pp. 836-838, vol. 30, No. 9.
Belhaj et al., Plant genome editing made easy: targeted mutagenesis in model and crop plants using the CRISPR/Cas system, Plant Methods, 2013, pp. 39-48, vol. 9.
Cho et al: "Analysis of off-target effects of CRISPR/Cas-derived RNA-guided endonucleases and nickases", Genome Research, 2014, vol. 24, pp. 132-141.
Cong et al., Multiplex Genome Engineering Using CRISPR/Cas Systems, Sciencexpress Reports, Jan. 3, 2013, pp. 1-7, vol. 1.
D'Halluin et al., Targeted molecular trait stacking in cotton through targeted double-strand break induction, Plant Biotechnology Journal, pp. 933-941, vol. 11, Jun. 18, 2013.
Endo et al: "Toward establishing an efficient and versatile gene targeting system in higher plants", Biocatalysis and Ag Biotech, 2014, vol. 3 pp. 2-6.
Esvelt et al: "Orthogonal Cas9 proteins for RNA-guided gene regulation and editing", Nature Methods, Sep. 29, 2013, pp. 1116-1121, vol. 10 No. 11.
Feng et al., Efficient genome editing in plants using a CRISPR/Cas system, Cell Research, 2013, pp. 1229-1232, vol. 23.
Fichtner et al: "Precision genetic modifications: a new era in molecular biology and crop improvement", Planta 239:921-39 (2014).
Funke et al., Structural Basis of Glyphosate Resistance Resulting from the Double Mutation Thr 97 Ile and Pro101 Ser in 5-Enolpyruvylshikimate-e-phosphate synthase from *Escherichia coli*. J Biol Chem vol. 284 No. 15 pp. 9854-9860, Apr. 10, 2009.
Giedrius Gasiunas et al., Cas9-crRNA ribonucleoprotein complex mediates specific DNA cleavage for adaptive immunity in bacteria, PNAS, Sep. 4, 2012, e2579-2586.
Gilbert et al., CRISPR-Mediated Modular RNA-Guided Regulation of Transcription in Eukaryotes, Cell, Jul. 18, 2013, pp. 442-451, vol. 154(2).
Hsu et al., DNA targeting specificity of RNA-guided Cas9 nucleases, Nature Biotechnology, Sep. 2013, pp. 827-834, vol. 31, No. 9.
Hwang et al., Efficient In Vivo Genome Editing Using RNA-Guided Nucleases, Nature Biotech, Mar. 2013, pp. 227-229, vol. 31, No. 3.
Jiang et al., "Demonstration of CRISPR/Cas9/sgRNA-mediated targeted gene modificaiton in *Arabidopsis*, tobacco, sorghum and rice", Nucleic Acids Research, Sep. 2, 2013, pp. e188-e188, XP055219328, vol. 41 No. 20.
Wenzhi Jiang et al., "Efficient CRISPR/Cas9-mediated gene edigin in *Arabidopsis thalian* and inheritance of modified genes in the T2 and T3 generations", PLOS ONE, vol. 9 No. 6, Jun. 11, 2014, p. e99225, XP055219594.
Kumar et al: "The CRISPR-Cas system for plant genome editing: advances and opportunities", Journal of Experimental Botany, vol. 66, No. 1, Nov. 4, 2014, pp. 47-57.
Li et al.: "Site-Specific Integration of Transgenes in Soybean via Recombinase-Mediated DNA Cassette Exchange", Plant Physiology 2009, vol. 151 pp. 1087-1095.
Jian-Feng Li et al., Multiplex and homologous recombination-mediated genome editing in *Arabidopsis* and Nicotiana benthamiana using guide RNA and Cas9, Nature Biotechnology, Aug. 2013, pp. 688-691, vol. 31, No. 8 (and Supplemental).
Lieber et al., The Mechanism of Double-Strand DNA Break Repair by the Nonhomologous DNA End Joining Pathway, Annu Rev Biochem, 2010, pp. 181-211, vol. 79.
Ming Ma et al., A Guide RNA Sequence Design Platform for the CRISPR/Cas9 System for Model Organism Genomes, BioMed Research International, 2013, 4 pages, Article ID 270805.
Makarova et al., Evolution and classification of the CRISPR-Cas systems, Nat Rev Microbiol, Jun. 2011, pp. 467-477, vol. 9(6).
Mao et al., Comparison of nonhomologous end joining and homologous recombination in human cells, DNA Repair, 2008, 7:1765-1771.
Mao et al., Application of the CRISPR-Cas System for Efficient Genome Engineering in Plants, Molecular Plant, Nov. 2013, pp. 2008-2011, vol. 6, No. 6.
Marraffini et al., CRISPR interference: RNA-directed adaptive immunity in bacteria and archaea, Nat Rev Genet, Mar. 2010, pp. 181-190, vol. 11(3).
Martin-Ortigosa et al: "Mesoporous silica nanoparticle-mediated intracellular Cre protein delivery for maize genome editing via loxP sigte excision", Plant Physio, vol. 164, Issue 2, Feb. 2014, pp. 537-547.
Martin-Ortigosa et al: "Proteolistics: a biolistic method for intracellular delivery of proteins", Transgenic Res, vol. 23, Aug. 5, 2014, pp. 743-756.
Miao et al., Targeted mutagenesis in rice using CRISPR-Cas System, Cell Research, 2013, pp. 1233-1236, vol. 23.
Nekrasov et al., Targeted mutagenesis in the model plant *Nicotiana benthamiana* using Cas9 RNA-guided endonuclease, Nature Biotechnology, pp. 691-693, vol. 31, No. 8, Aug. 2013.
Ow: "Recombinase-mediated Gene Stacking as a Transformation Operating System", J Integrative Plant Biol 2011, vol. 53 No. 7 pp. 512-519.
Podevin et al., Site-directed nucleases: a paradigm shift in predictable, knowledge-based plant breeding, Trends in Biotechnology, Jun. 2013, pp. 375-383, vol. 31, No. 6.

(56) References Cited

OTHER PUBLICATIONS

Puchta et al: "Gene replacement by homologous recombination in plants", Plant Mol Biol, 2002, vol. 48 pp. 173-182.
Puchta et al: "Synthetic nucleases for genome engineering in plants: prospects for a bright future", The Plant Journal, 2014, vol. 78, pp. 727-741.
Lei S. Qi et al., Repurposing CRISPR as an RNA-Guided Platform for Sequence-Specific Control of Gene Expression, Cell, Feb. 28, 2013, pp. 1173-1183, vol. 152(5).
Que et al: "Trait stacking in transgenic crops: Challenges and opportunities", GM Crops 2010, vol. 1 Issue 4, pp. 220-229.
Sadowski, Site-specific genetic recombination: hops, flips, and flops, FASEB, 1993, pp. 760-767, vol. 7.
Sauer, Site-specific recombination: developments and applications, Current Opinion in Biotechnology, 1994, pp. 521-527, vol. 5.
Shan et al., Targeted genome modification of crop plants using a CRISPR-Cas system, Nature Biotechnology, Aug. 2013, pp. 686-688, vol. 31, No. 8 (and Supplemental).
Voytas, Plant Genome Engineering with Sequence-Specific Nucleases, Annual Review of Plant Biology, pp. 327-350, vol. 64, Mar. 1, 2013.
Wei et al., Physical and Genetic Structure of the Maize Genome Reflects Its Complex Evolutionary History, PLoS Genetics, Jul. 2007, vol. 3 Issue 7, pp. 1254-1263.
Xie et al., RNA-Guided Genome Editing in Plants Using a CRISPR-Cas System, Nov. 2013, Molecular Plant, pp. 1975-1983, vol. 6, No. 6.
Xing e al., "A CRISPR/Cas9 toolkit for multiplex genome editing in plants", BMC Plant Biol, 2014, vol. 14 No. 1, pp. 327-338.
Zhang, "Transcription Activator-Like Effector Nucleases Enable Efficient Plant Genome Engineering",Plant Physiology, 2013, vol. 161, pp. 20-27.
Zhang et al., "The CRISPR/Cas9 system produces specific and homozygous targeted gene editing in rice in one generation", Plant Biotech J, 2014, vol. 12 No. 6, pp. 797-807.

* cited by examiner

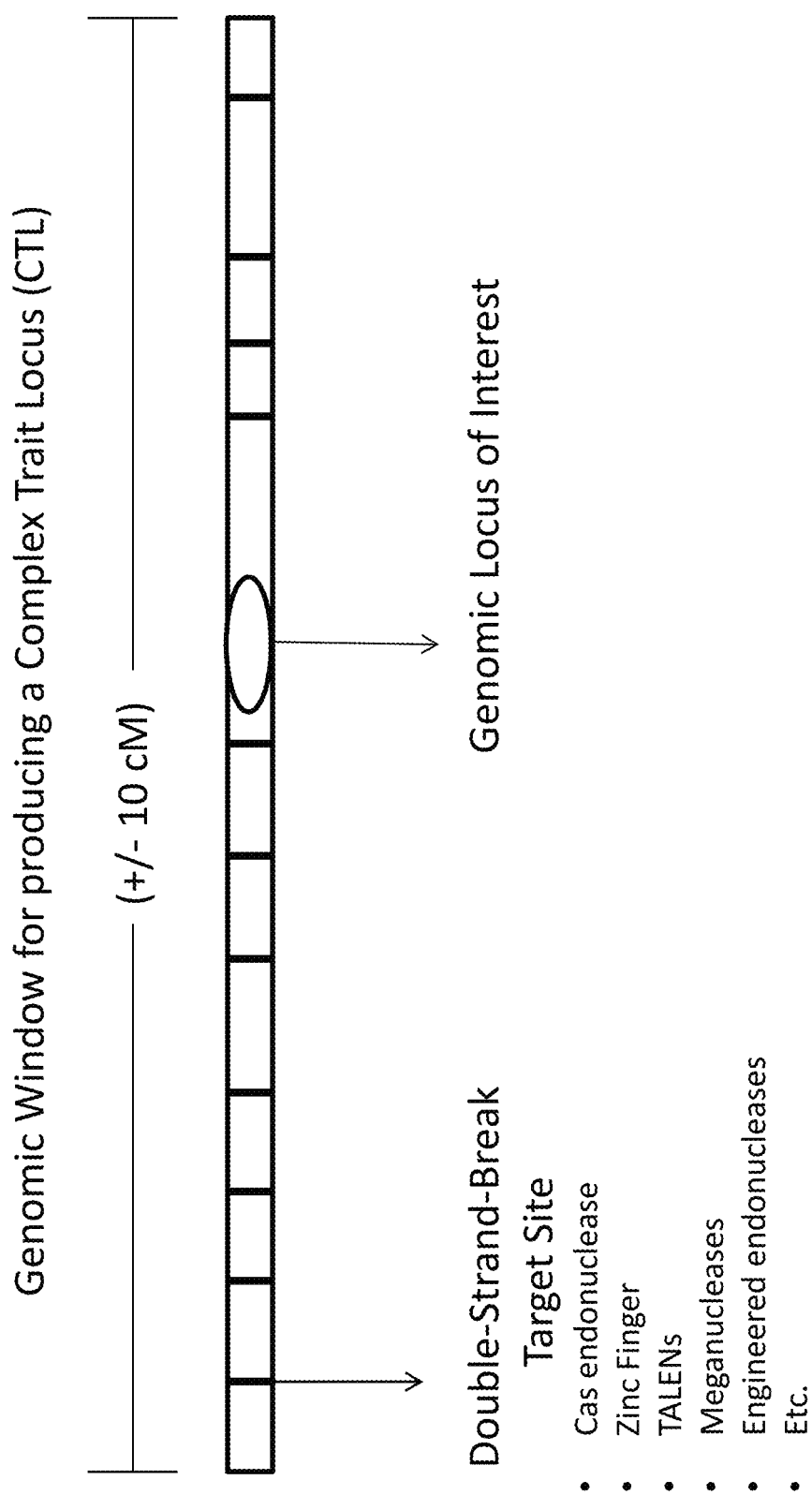

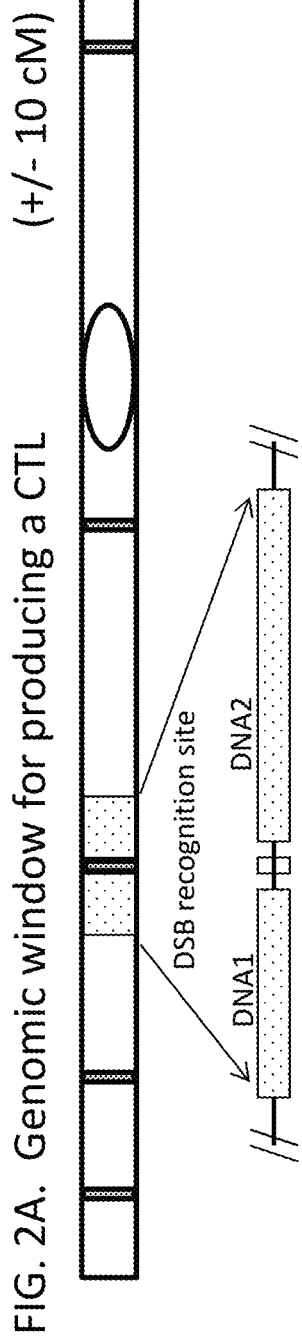
FIG. 2A. Genomic window for producing a CTL
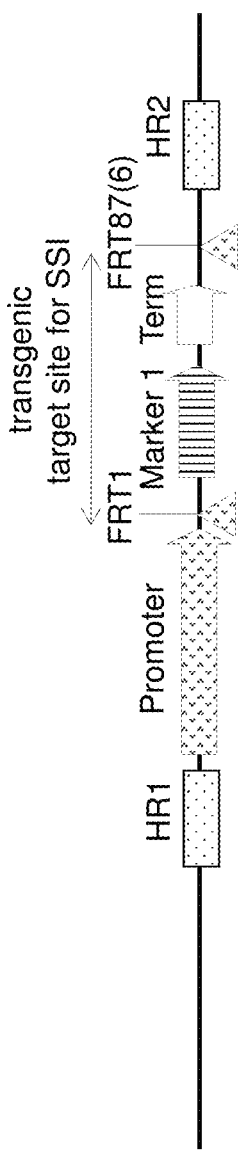
FIG. 2B. Donor (Repair) DNA for integration of transgenic target site for SSI
FIG. 2C. Guide RNA and Cas9 endonuclease expression cassettes

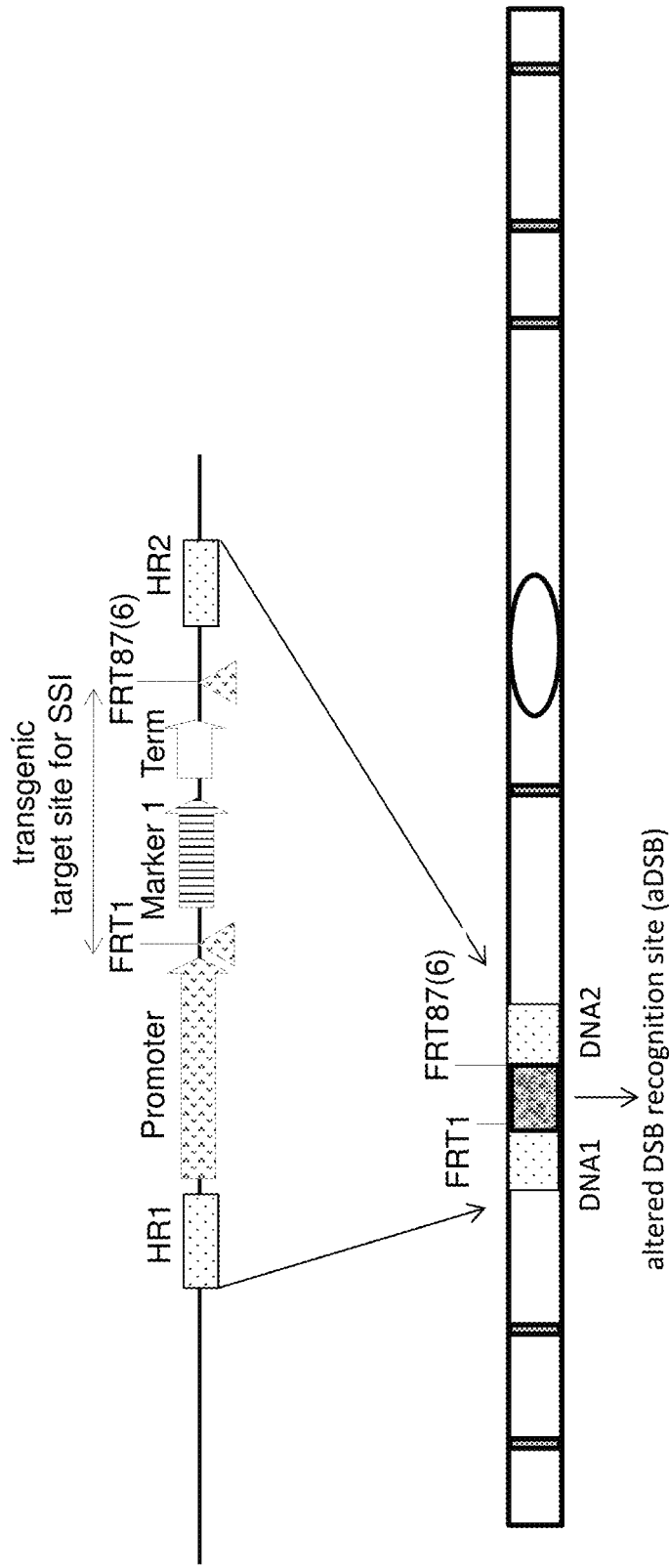
FIG. 2D. New transgenic target site for SSI integrated in genomic window

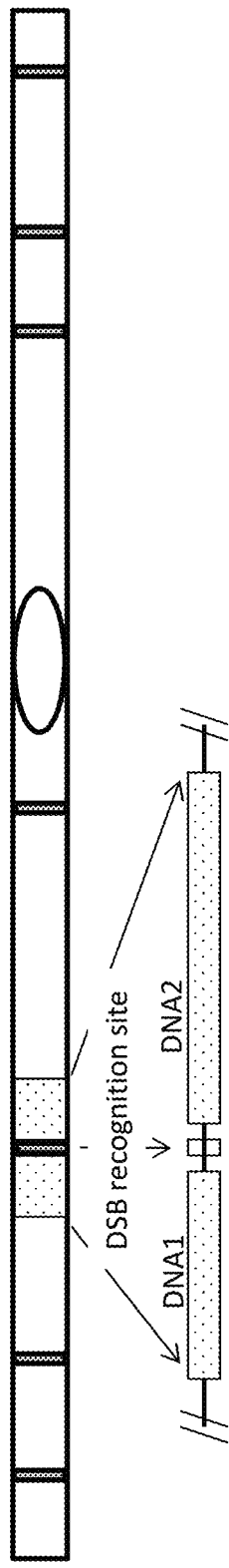
FIG. 3A. Genomic window for producing a CTL
FIG. 3B. Donor (Repair) DNA for Trait integration
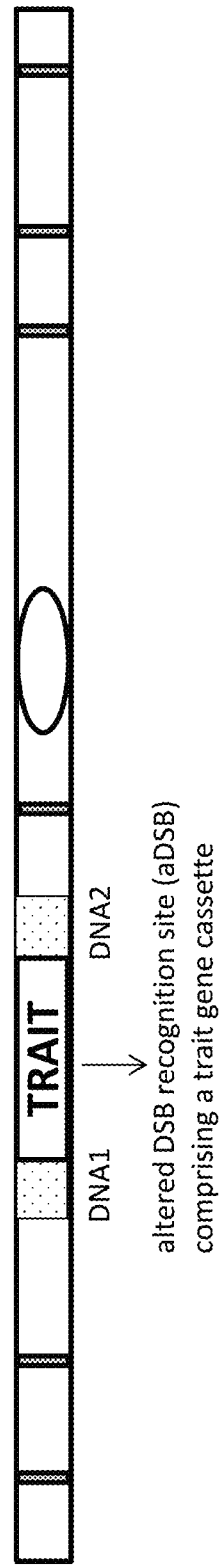
FIG. 3C. New trait cassette(s) integrated in genomic window Maize Genomic Window (CTL1) on Chromosome 1

Maize Genomic Window (CTL4) on Chromosome 10

GENERATION OF SITE-SPECIFIC-INTEGRATION SITES FOR COMPLEX TRAIT LOCI IN CORN AND SOYBEAN, AND METHODS OF USE

CROSS-REFERENCE TO RELATED APPLICATIONS

This application is a 371 National Stage Entry of PCT Application No. PCT/US2015/047706 filed 31 Aug. 2015, which claims the benefit of U.S. Provisional Application No. 62/049,465, filed Sep. 12, 2014, all of which are incorporated herein in their entirety by reference.

FIELD

The disclosure relates to the field of plant molecular biology. In particular, methods and compositions are provided for altering the genome of a plant.

REFERENCE TO A SEQUENCE LISTING SUBMITTED AS A TEXT FILE VIA EFS-WEB

The official copy of the sequence listing is submitted electronically via EFS-Web as an ASCII formatted sequence listing with a file named 20150811_BB2355PCT_ST25.txt, created Aug. 11, 2015 and having a size of 879 KB and is filed concurrently with the specification. The sequence listing contained in this ASCII formatted document is part of the specification and is herein incorporated by reference in its entirety.

BACKGROUND

Recombinant DNA technology has made it possible to insert foreign DNA sequences into the genome of an organism, as well as altering endogenous genes of an organism, thus, altering the organism's phenotype. The most commonly used plant transformation methods are *Agrobacterium* infection and biolistic particle bombardment in which transgenes integrate into a plant genome in a random fashion and in an unpredictable copy number.

Site-specific integration techniques, which employ site-specific recombination systems, as well as, other types of recombination technologies, have been used to generate targeted insertions of genes of interest in a variety of organism. Other methods for inserting or modifying a DNA sequence involve homologous DNA recombination by introducing a transgenic DNA sequence flanked by sequences homologous to the genomic target. U.S. Pat. No. 5,527,695 describes transforming eukaryotic cells with DNA sequences that are targeted to a predetermined sequence of the eukaryote's DNA. Transformed cells are identified through use of a selectable marker included as a part of the introduced DNA sequences. While such systems have provided useful techniques for targeted insertion of sequences of interest, there remains a need for methods and compositions which improve these systems and allow for targeting the insertion of a sequence of interest into a desirable genomic position, for stacking additional polynucleotides of interest near the desired integration site, and for producing a fertile plant, having an altered genome comprising one or more transgenic target sited for site specific integration located in a defined region of the genome of the plant.

BRIEF SUMMARY

Methods and compositions for introducing transgenic target sites for Site Specific Integration (SSI) into at least one target site of a double-strand-break inducing agent (referred to as double-strand break target site, or DSB target site) in a genomic window of a plant genome are provided. Composition and methods are also provided for introducing a polynucleotide of interest into a target site of a double-strand-break inducing agent (such as but not limited to a Cas9 endonuclease) in a genomic window of a plant. Also provided are methods and compositions for producing a complex trait locus in a genomic window of a plant, the plant comprising at least one transgenic target site for SSI integrated in at least one double-strand break target site. The double-strand break target site can be, but is not limited to a zinc finger endonuclease target site, an engineered endonuclease target site, a meganuclease target site, a TALENs target site and a Cas endonuclease target site. The genomic window of said plant can optionally comprise at least one genomic locus of interest such as a trait cassette, a transgene, a mutated gene, a native gene, an edited gene or a site-specific integration (SSI) target site.

The compositions provide a plant, plant part, plant cell, or seed having in its genome a genomic window comprising at least one transgenic target site for site specific integration (SSI) integrated into at least one double-strand break target site, wherein said genomic window is flanked by (genetically linked to) at least a first marker and at least a second marker. The compositions further provide a plant, plant part or seed having in its genome a genomic window comprising at least one transgenic target site for site specific integration integrated into at least one double-strand break target site, wherein said at least one transgenic target site is genetically linked to at least a first genetic marker and a second genetic marker, wherein said first genetic marker is located between a first and a second location on a plant physical map. The compositions further provide a plant, plant part or seed having in its genome a genomic window comprising at least one double-strand break target site, wherein said genomic window is flanked by (genetically linked to) at least a first marker and at least a second marker, and wherein said genomic window comprises a transgene. The compositions further provide a plant, plant part or seed having in its genome a genomic window comprising at least one altered double-strand break target site, wherein said genomic window is flanked by (genetically linked to) at least a first marker and at least a second marker, and wherein said altered double-strand break target site comprises a polynucleotide of interest.

Also provided are plants, plant part or seed having in its genome at least one transgenic target site for site specific integration (SSI) integrated into at least one Cas endonuclease target site.

Further provided are methods for introducing into the genome of a plant cell a transgenic target site for site-specific integration. In one embodiment, the method comprising: (a) providing a plant cell comprising in its genome an endogenous target site for a Cas endonuclease; (b) providing a Cas endonuclease and guide polynucleotide, wherein the Cas endonuclease is capable of forming a complex with the guide polynucleotide, wherein said complex is capable of inducing a double-strand break in said endogenous target site, and wherein the endogenous target site is located between a first and a second genomic region that is capable of guiding the Cas endonuclease of (a) to said endogenous target site; (c) providing a donor DNA comprising the transgenic target site for site-specific integration located between a first region of homology to said first genomic region and a second region of homology to said second genomic region, wherein the transgenic target site comprises a first and a second recombination site, wherein the first and the second recombination sites are dissimilar with respect to one another; (d) contacting the plant cell with the guide polynucleotide, the donor DNA and the Cas endonuclease; and, (e) identifying at least one plant cell from (d) comprising in its genome the transgenic target site integrated at said endogenous target site.

In another embodiment, the method comprises a method of integrating a polynucleotide of interest into a transgenic target site in the genome of a plant cell, the method comprising: (a) providing at least one plant cell comprising in its genome a transgenic target site for site-specific integration, wherein the transgenic target site is integrated into an endogenous target site for a Cas endonuclease, and wherein the transgenic target site is, (i) a target site comprising a first and a second recombination site; or (ii) the target site of (i) further comprising a third recombination site between the first recombination site and the second recombination site, wherein the first, the second, and the third recombination sites are dissimilar with respect to one another, (b) introducing into the plant cell of (a) a transfer cassette comprising, (iii) the first recombination site, a first polynucleotide of interest, and the second recombination site, (iv) the second recombination site, a second polynucleotide of interest, and the third recombination sites, or (v) the first recombination site, a third polynucleotide of interest, and the third recombination sites; (c) providing a recombinase that recognizes and implements recombination at the first and the second recombination sites, at the second and the third recombination sites, or at the first and third recombination sites; and (d) selecting at least one plant cell comprising integration of the transfer cassette at the target site.

The compositions further provide a nucleic acid molecule comprising an RNA sequence selected from the group consisting of SEQ ID NOs: 267-307, 441-480, and any one combination thereof. In one embodiment the DSB target site is a Cas9 endonuclease target site selected from the group of consisting of SEQ ID NO: 3-5, 7-11, 13-19, 21-23, 25-28, 30-34, 36-39, 43-47, 49-52, 54-58, 60, 63-66, 68-72, 74-78, 80-83, 87-90, 92-93, 95-98, 100-104, 317-320, 323-324, 327-328, 331-332, 334-337, 342-343, 346-347, 350-351, 354-355, 358-359, 365-366. 370-371, 376-377, 380-381, 384-385, 388-389, 392-393 and 396-397.

Also provided are methods and compositions for producing a complex trait locus in a genomic window of a plant, the plant comprising at least one transgenic target site for site specific integration integrated in at least double-strand-break target site. The double-strand-break target site can be, but is not limited to a zinc finger endonuclease target site, an engineered endonuclease target site, a meganuclease target site, a TALENs target site and a Cas endonuclease target site. The genomic window of said plant can optionally comprise at least one genomic locus of interest such as a trait cassette, a transgene, a mutated gene, a native gene, an edited gene or a site-specific integration (SSI) target site. Plant breeding techniques can be employed such that the transgenic target site for SSI and the genomic locus of interest can be bred together. In this way, multiple independent trait integrations can be generated within a genomic window to create a complex trait locus. The complex trait locus is designed such that its target sites comprising traits of interest and/or genomic loci of interest can segregate independently of each other, thus providing the benefit of altering a complex trait locus by breeding-in and breeding-away specific elements. Various methods can also be employed to modify the target sites such that they contain a variety of polynucleotides of interest. Also provided is a method of producing a complex trait locus in the genome of a plant comprising applying plant breeding techniques to a first plant having in its genome a genomic window of about 10 cM with at least a first transgenic target sites for Site Specific Integration (SSI) integrated into at least a first double-strand break target site (such as but not limited to a Cas9 endonuclease target site). The method comprises breeding to said first plant a second plant comprising a first genomic locus of interest (such as trait cassette, a transgene, a mutated gene, a native gene, an edited gene or a site-specific integration (SSI) target site) in the genomic window and selecting a progeny comprising said first transgenic target site for Site Specific Integration (SSI) integrated into said first double-strand break target site and said first genomic locus of interest, wherein said first transgenic target site and said first genomic locus have different genomic insertion sites in said progeny plant. Using such methods, various transgenic target sites and/or polynucleotides of interest can be introduced into double-strand break target sites of a genomic window. Also provided are methods of altering the complex trait locus by utilizing various breeding techniques or by employing site-specific recombination techniques to add, remove, or replace double-strand break target sites, genomic loci of interest or polynucleotides of interest.

BRIEF DESCRIPTION OF THE DRAWINGS

FIG. 1. Schematic of a genomic window for producing a Complex Trait Locus (CTL). The genomic window can be about 10 cM in length (genomic distance) and comprises at least one double-strand break target site. The double-strand break target site can be, but is not limited to, Cas endonuclease target site, a zinc finger endonuclease target site, an engineered endonuclease target site, a meganuclease target site and a TALENs target site. The genomic window of said plant can optionally comprise at least one genomic locus of interest such as trait cassette, a transgene, a mutated gene, a native gene, an edited gene or a site-specific integration (SSI) target site.

FIG. 2A-2D. Schematic of the insertion of a transgenic target site for site specific integration (SSI) into a double-strand break-target site located in a genomic window. FIG. 2A show the genomic window for producing a Complex Trait Locus (CTL) of about 10 cM in length, the genomic window comprises at least one double-strand break target site (DSB target site) flanked by a DNA1 and DNA2 endogenous DNA sequence. FIG. 2B shows a donor (repair) DNA for integration of a transgenic target site for SSI. FIG. 2C shows a schematic of a guide RNA and Cas9 endonuclease expression cassette, either located on one molecule of located on separate molecules. FIG. 2D shows a schematic of the transgenic target site for SSI integrated in the genomic window. This integration results in the alteration of the DSB target site (referred to as a DSB). FRT1 (FLP Recognition Target (FRT)) and FRT87 (or FRT6) are shown as non-limiting examples of recombination sites flanking the transgenic target site for SSI. Other recombination sites can be used.

FIG. 3A-3C shows a schematic of the insertion of a trait cassette into a DSB target site located in a genomic window. FIG. 3A shows the genomic window for producing a CTL. FIG. 3B shows a schematic of a donor (repair) DNA for integration of a trait cassette. FIG. 3C shows a schematic of the trait cassette integrated in the genomic window.

SEQUENCES

Figure 4:
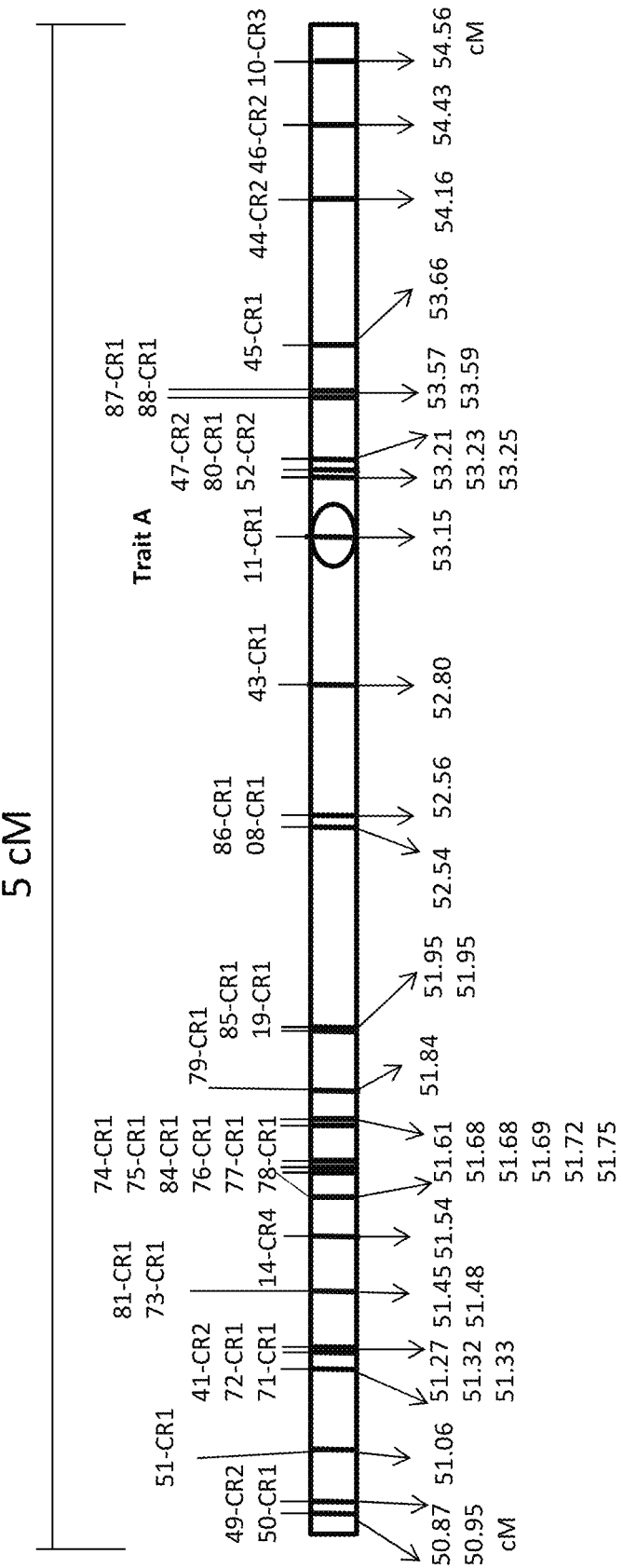
FIG. 4 shows a schematic of the maize genomic window (CTL1) on chromosome 1. The genomic window is about 5 cM in length and contains 31 Cas endonuclease target sites (listed above the bar diagram representing the genomic window, such as 49-CR1) located near trait A (represented by an oval). The genetic location (cM) of each of the Cas endonuclease target sites is shows below the bar diagram (for example target site 49-CR2 is located at 50.87 cM on chromosome 1).

SEQ ID NOs: 1-41 are the nucleotide sequences of Cas endonuclease target sites or SNP markers located in a genomic window (CTL1) on chromosome 1 of maize (see also Table 1).

SEQ ID NOs: 42-61 are the nucleotide sequences of Cas endonuclease target sites or SNP markers located in a genomic window (CTL2) on chromosome 1 of maize (see also Table 2).

SEQ ID NOs: 62-84 are the nucleotide sequences of Cas endonuclease target sites or SNP markers located in a genomic window (CTL3) on chromosome 3 of maize (see also Table 3).

SEQ ID NOs: 85-105 are the nucleotide sequences of Cas endonuclease target sites or SNP markers located in a genomic window (CTL4) on chromosome 10 of maize (see also Table 4).

SEQ ID NOs: 106-135 and 136-146 are the nucleotide sequences of guide RNA/Cas9 DNA's used in maize.

SEQ ID NOs: 267-296 and 297-307 are the nucleotide sequences of guide RNAs used in maize.

SEQ ID NOs: 147-266 are the nucleotide sequences of Primers/Probes.

SEQ ID NO: 308 is the nucleotide sequence of the Cas9 gene from *Streptococcus pyogenes* M1 GAS (SF370).

SEQ ID NO: 309 is the amino acid sequence of SV40 amino N-terminal.

SEQ ID NO: 310 is the amino acid sequence of *Agrobacterium tumefaciens* bipartite VirD2 T-DNA border endonuclease carboxyl terminal.

SEQ ID NO: 311 is the nucleotide sequence of a maize optimized Cas9 expression cassette.

SEQ ID NO: 312 is the nucleotide sequence of a maize U6 polymerase III promoter.

SEQ ID NO: 313 is the nucleotide sequence of a soybean codon optimized Cas9 gene.

SEQ ID NO: 314 is the amino acid sequence of SV40 amino N-terminal with a SRAD linker.

SEQ ID NO: 315 is the nucleotide sequence of GM-U6-13.1 promoter.

SEQ ID NOs: 316-339 are the nucleotide sequences of Cas endonuclease target sites or SNP markers located in a genomic window (CTL-D) on chromosome 4 of soybean (see also Table 12).

SEQ ID NOs: 340-362 are the nucleotide sequences of Cas endonuclease target sites or SNP markers located in a genomic window (CTL-X) on chromosome 6 of soybean (see also Table 13).

SEQ ID NOs: 363-399 are the nucleotide sequences of Cas endonuclease target sites or SNP markers located in a genomic window (CTL-R) on chromosome 1 of soybean (see also Table 14).

SEQ ID NOs: 400-413, 415-424 and 425-440 are the nucleotide sequences of guide RNA/Cas 9 DNA's used in soybean.

SEQ ID NO: 414 is the nucleotide sequence the soybean U6 small nuclear RNA promoters GM-U6-9.1.

SEQ ID NOs: 441-480 are the nucleotide sequences of guide RNAs used in soybean.

SEQ ID NOs: 481-570 are the nucleotide sequences of Primers/Probes.

SEQ ID NO: 571 is the nucleotide sequence of a Cas9 endonuclease (genbank CS571758.1) from *S. thermophilus*.

SEQ ID NO: 572 is the nucleotide sequence of a Cas9 endonuclease, (genbank CS571770.1) from *S. thermophilus*.

SEQ ID NO: 573 is the nucleotide sequence of a Cas9 endonuclease, (genbank CS571785.1) from *S. agalactiae*.

SEQ ID NO: 574 is the nucleotide sequence of a Cas9 endonuclease, (genbank CS571790.1) from *S. agalactiae*.

SEQ ID NO: 575 is the nucleotide sequence a Cas9 endonuclease (genbank CS571790.1) from *S. mutans*.

SEQ ID NO: 576 is the nucleotide sequence of the FRT1 recombination site.

SEQ ID NO: 577 is the nucleotide sequence of the FRT5 recombination site.

SEQ ID NO: 578 is the nucleotide sequence of the FRT6 recombination site.

SEQ ID NO: 579 is the nucleotide sequence of the FRT12 recombination site.

SEQ ID NO: 580 is the nucleotide sequence of the FRT87 recombination site.

DETAILED DESCRIPTION

Many modifications and other embodiments of the disclosures set forth herein will come to mind to one skilled in the art to which this disclosure pertains having the benefit of the teachings presented in the foregoing descriptions and the associated drawings. Therefore, it is to be understood that the disclosure is not to be limited to the specific embodiments disclosed and that modifications and other embodiments are intended to be included within the scope of the appended claims. Although specific terms are employed herein, they are used in a generic and descriptive sense only and not for purposes of limitation.

Provided herein are plants, plant parts, plant cells or seeds having in its genome a genomic window. A genomic window can refers to a segment of a chromosome in the genome of a plant that is desirable for producing a complex trait locus or the segment of a chromosome comprising a complex trait locus that was produced by the methods provided herein. The genomic window can include, for example, one or more traits prior to producing a complex transgenic trait locus therein (see for example FIG. 1). As used herein, a "trait" refers to the phenotype conferred from a particular gene or grouping of genes.

The genomic window can be about 1, 2, 3, 4, 5, 6, 7, 8, 9, 10, 11, 12, 13, 14, 15 or more centimorgans (cM) in length. Alternatively, the genomic window can be about 1-10 cM, about 2-8 cM, about 2-5 cM, about 3-10 cM, about 3-6 cM, about 4-10 cM, about 4-7 cM, about 5-10 cM, about 5-8 cM, about 6-10 cM, about 6-9 cM, about 7-10 cM, about 8-10 cM or about 9-10 cM in length. In one embodiment, the genomic window is about 3 centimorgans (cM) in length or about 4 cM in length, or about 5 cM in length, or about 6 cM in length, or about 10 cM in length. A "centimorgan" (cM) or "map unit" is the distance between two linked genes, markers, target sites, genomic loci of interest, loci, or any pair thereof, wherein 1% of the products of meiosis are recombinant. Thus, a centimorgan is equivalent to a distance equal to a 1% average recombination frequency between the two linked genes, markers, target sites, loci, genomic loci of interest or any pair thereof.

The genomic window can comprise various components. Such components can include, for example, but not limited to, double-strand break target sites, genomic loci of interest, native genes, transgenic target sites for SSI (site-specific integration recombination sites), mutated genes, edited genes, trait cassettes and polynucleotides of interest. The genomic window can comprise at least 1, 2, 3, 4, 5, 6, 7, 8, 9, 10, 11, 12, 13, 14, 15, 16, 17, 19, 19, 20, 21, 22, 23, 24, 25, 26, 27, 28, 29, 30, 31 or more double-strand break target sites such that each double-strand break target site has a different genomic insertion site within the genomic window. In addition, the genomic window can comprise at least 1, 2, 3, 4, 5, 6, 7, 8, 9, 10, 11, 12, 13, 14, 15, 16, 17, 19, 19, 20, 21, 22, 23, 24, 25, 26, 27, 28, 29, 30, 31 or more genomic loci of interest each having a different genomic insertion site. By a "different genomic insertion site" is meant that each component of the genomic window (such as for example double-strand break target sites and genomic loci of interest) is inserted into the genome at a different location and as such each component can segregate independently from one another. For example, the genomic window can comprise a combination of double-strand break target sites and/or genomic loci of interest such that each target site or genomic loci of interest has a different genomic insertion site within the genomic window.

The components of the genomic windows provided herein have different genomic insertion sites and as such can segregate independently from one another. As used herein, "segregate independently", is used to refer to the genetic separation of any two or more genes, transgenes, native genes, mutated genes, target sites, genomic loci of interest, markers and the like from one another during meiosis. Assays to measure whether two genetic elements segregate independently are known in the art. As such, any two or more genes, transgenes, native genes, mutated genes, target sites, genomic loci of interest, markers and the like within a genomic window provided herein, have genomic insertion sites located at an appropriate distance from one another so that they generally segregate independently at a rate of about 10% or less. Thus, the components of the genomic windows provided herein can segregate independently from one another at a rate of about 10%, 9%, 8%, 7%, 6%, 5%, 4%, 3%, 2%, 1%, 0.9%, 0.8%, 0.70%, 0.6%, 0.5%, 0.4%, 0.3%, 0.2% or 0.1%. Alternatively, the components of the genomic windows provided herein can segregate independently from one another at a rate of about 10-0.1%, about 10-0.5%, about 10-1%, about 10-5%, about 9-0.1%, about 9-0.5%, about 9-1%, about 9-5%, about 8-0.1%, about 8-0.5%, about 8-1%, about 8-4%, about 7-0.1%, about 7-0.5%, about 7-1%, about 7-4%, about 6-0.1%, about 6-1%, about 6-0.5%, about 6-3%, about 5-0.1%, about 5-1%, about 5-0.5%, about 4-0.1%, about 4-1%, about 4-0.5%, about 3-0.1%, about 3-1%, about 3-0.5%, about 2-0.1%, about 2-0.5%, about 1-0.1% or about 1-0.5%. For example, if the genomic window comprises a double-strand break target site and a genomic locus of interest that are about 5 cM from each other, the double-strand break target site and the genomic locus of interest would segregate independently at a rate of about 5%.

In one embodiment, the genomic window comprises at least five different double-strand break target sites (such as at least five Cas9 endonuclease target sites) and at least one transgenic target site for site specific integration (also referred to as transgenic SSI target site) wherein each of the Cas endonuclease target sites and the transgenic SSI target site have a different genomic insertion site and segregate independently from one another at a rate of about 10% to about 0.1%.

In specific embodiments, the genomic window is flanked by at least a first marker and a second marker. Non-limiting examples of such markers on chromosome 1 of maize include, for example, SYN12545, SYN12536, SYN14645, PZE-101023852, PZE-101024424, SYN25022, SYN31156, SYN31166, SYN22238 or SYN20196, and PZE-101205031, PUT-163A-148951459-517, PZE-101205904, PZE-101206569 or SYN24492. Other non-limiting examples of such markers on chromosome 3 of maize include, for example, PZE-103000166, PZE-103000238, PZE-103000307, SYN6355 or PZE-103001421, and on chromosome 10 of maize, for example, PZE-110099037, PZE-110099048, PZE-110100195, PZE-110100685 or PZE-110101412. Non-limiting examples of such markers on chromosome 4 of soybean include, for example, BARC_1.01_Gm04_45591011_C_T, BARC_1.01_Gm04_45613405_T_C, BARC_1.01_Gm04_45697256_G_A, BARC_1.01_Gm04_45739051_A_C,
BARC_1.01_Gm04_45800267_T_C,
BARC_1.01_Gm04_45857325_T_C,
BARC_1.01_Gm04_45857325_T_C,
BARC_1.01_Gm04_45883080_A_G,
BARC_1.01_Gm04_45903617_T_C,
BARC_1.01_Gm04_46000185_C_A or
BARC_1.01_Gm04_46113406_T_G. Non-limiting examples of such markers on chromosome 6 of soybean include, for example, BARC_1.01_Gm06_46915875_T_C,
BARC_1.01_Gm06_47524452_G_T,
BARC_1.01_Gm06_47561262_C_T,
BARC_1.01_Gm06_47625670_C_T,
BARC_1.01_Gm06_47631544_T_C,
BARC_1.01_Gm06_47789229_C_T,
BARC_1.01_Gm06_47821576_T_G,
BARC_1.01_Gm06_47829363_A_C,
BARC_1.01_Gm06_47833095_A_G,
BARC_1.01_Gm06_47847021_G_T,
BARC_1.01_Gm06_47895876_G_A,
BARC_1.01_Gm06_48221293_T_C or
BARC_1.01_Gm06_48528885_G_T.
Non-limiting examples of such markers on chromosome 1 of soybean include, for example,
BARC_1.01_Gm01_6984873_T_C,
BARC_1.01_Gm01_7775299_G_A,
BARC_1.01_Gm01_7856395_A_C,
BARC_1.01_Gm01_8569887_A_G,
BARC_1.01_Gm01_8601858_C_T,
BARC_1.01_Gm01_8641430_C_T,
BARC_1.01_Gm01_8674202_A_C,
BARC_1.01_Gm01_8933345_C_T,
BARC_1.01_Gm01_8964201_T_C,
BARC_1.01_Gm01_9014216_T_G,
BARC_1.01_Gm01_28179606_A_G,
BARC_0.01_Gm01_28364595_A_G,
BARC_1.01_Gm01_28536363_G_A,
BARC_0.01_Gm01_28599526_G_A,
BARC_1.01_Gm01_28913996_A_G,
BARC_0.01_Gm01_29284158_A_G,
BARC_1.01_Gm01_31202345_C_T,
BARC_0.01_Gm01_31770743_C_T,
BARC_1.01_Gm01_32683433_G_A,
BARC_0.01_Gm01_34327255_C_T or
BARC_1.01_Gm01_36994849_A_G.

As used herein, a "genomic locus of interest" (plural genomic loci of interest) comprises a collection of specific polymorphisms that are inherited together. A given genomic locus can comprise, but is not limited to, a modified or edited native gene, a transgene, an altered double-strand-break target site, a native gene, or a transgenic SSI target site that can comprise dissimilar pairs of recombination sites or pairs of recombination sites that are dissimilar and have a decreased compatibility with respect to one another.

The genomic locus of interest can be, for example, any modification that confers a trait, such as a transgene or a native trait. In one embodiment, the genomic locus of interest comprises a native trait. As used herein, a "native trait" refers to a trait found in nature. In another embodiment, the genomic locus of interest comprises a transgene.

The number of genomic loci of interest that could be crossed into a genomic window of a plant is at least 1, 2, 3, 4, 5, 6, 7, 8, 9, 10, 11, 12, 13 or more. Any desired trait can be introduced into the genome at a given genomic locus of interest. Such traits include, but are not limited to, traits conferring insect resistance, disease resistance, herbicide tolerance, male sterility, abiotic stress tolerance, altered phosphorus, altered antioxidants, altered fatty acids, altered essential amino acids, altered carbohydrates, or sequences involved in site-specific recombination.

In specific embodiments, a given genomic locus of interest is associated with a desirable and/or favorable phenotype in a plant. For example, traits that confer insect resistance, disease resistance or herbicide tolerance would be desirable in a plant. In other embodiments, the genomic locus is not associated with traits that affect the agronomic characteristics of the plant.

A given genomic locus of interest has its own genomic insertion site within the genomic window. For example, a genomic locus of interest and a double-strand-break target site within the genomic window will have different genomic insertion sites within the genome. A given double-strand-break target site can be found within about 10 cM, 9 cM, 8 cM, 7 cM, 6 cM, 5 cM, 4 cM, 3 cM, 2 cM, 1 cM, 0.9 cM, 0.8 cM, 0.7 cM, 0.6 cM, 0.5 cM, 0.4 cM, 0.3 cM, 0.2 cM, 0.1 cM or 0.05 cM from the genomic locus of interest such that the double-strand-break target site and genomic locus of interest have different genomic insertion sites. Alternatively, a given double-strand-break target site can be found within about 0.5-10 cM, about 1-10 cM, about 2-10 cM, about 2-5 cM, about 3-10 cM, about 3-6 cM, about 4-10 cM, about 4-7 cM, about 5-10 cM, about 5-8 cM, about 6-10 cM, about 6-9 cM, about 7-10 cM, about 8-10 cM, about 9-10 cM, about 0.1-0.5 cM, about 0.1-1 cM, about 0.1-2 cM, about 0.1-3 cM, about 0.1-4 cM, about 0.1-5 cM, about 0.1-6 cM, about 0.1-7 cM about 0.1-8 cM, about 0.1-9 cM or about 0.1-10 cM from the genomic locus of interest such that the double-strand-break target site and genomic locus of interest have different genomic insertion sites.

As used herein, the terms "double-strand-break target site", "DSB target site", "DSB target sequence", and "target site for a double-strand-break-inducing-agent" are used interchangeably and refer to a polynucleotide sequence in the genome of a plant cell (including choroplastic and mitochondrial DNA) that comprises a recognition sequence for a double-strand-break-inducing agent at which a double-strand-break is induced in the cell genome by a double-strand-break-inducing-agent.

As used herein, the terms "altered double-strand-break target site", "altered DSB target site", "aDSB target site", and "altered target site for a double-strand-break-inducing-agent" are used interchangeably and refer to a DSB target sequence comprising at least one alteration when compared to a non-altered DSB target sequence. "Alterations" can include, for example: (i) replacement of at least one nucleotide, (ii) a deletion of at least one nucleotide, (iii) an insertion of at least one nucleotide, or (iv) any combination of (i)-(iii).

The DSB target site can be an endogenous site in the plant genome, or alternatively, the DSB target site can be heterologous to the plant and thereby not be naturally occurring in the genome, or the DSB target site can be found in a heterologous genomic location compared to where it occurs in nature. As used herein, the term "endogenous DSB target site" refers to an DSB target site that is endogenous or native to the genome of a plant and is located at the endogenous or native position of that DSB target site in the genome of the plant.

The length of the DSB target site can vary, and includes, for example, DSB target sites that are at least 4, 6, 8, 10, 12, 14, 16, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more nucleotides in length. It is further possible that the DSB target site could be palindromic, that is, the sequence on one strand reads the same in the opposite direction on the complementary strand. The nick/cleavage site could be within the recognition sequence or the nick/cleavage site could be outside of the recognition sequence. In another variation, the cleavage could occur at nucleotide positions immediately opposite each other to produce a blunt end cut or, in other cases, the incisions could be staggered to produce single-stranded overhangs, also called "sticky ends", which can be either 5' overhangs, or 3' overhangs.

A "double-strand-break-inducing agent" (also referred to as "DSB-inducing-agent") refers to any nuclease which produces a double-strand break in the target sequence. The double-strand break target site can be, but is not limited to a zinc finger endonuclease target site, an engineered endonuclease target site, a meganuclease target site, a TALENs target site and a Cas endonuclease target site.

Any nuclease that induces a double-strand break into a desired DSB target site can be used in the methods and compositions disclosed herein. A naturally-occurring or native endonuclease can be employed so long as the endonuclease induces a double-strand break in a desired DSB target site. Alternatively, a modified or engineered endonuclease can be employed. An "engineered endonuclease" refers to an endonuclease that is engineered (modified or derived) from its native form to specifically recognize and induce a double-strand break in the desired DSB target site. Thus, an engineered endonuclease can be derived from a native, naturally-occurring endonuclease or it could be artificially created or synthesized. The modification of the endonuclease can be as little as one nucleotide. Producing a double-strand break in a DSB target site or other DNA can be referred to herein as "cutting" or "cleaving" the DSB target site or other DNA.

Active variants and fragments of the DSB target sites (i.e. SEQ ID NO: 3-5, 7-11, 13-19, 21-23, 25-28, 30-34, 36-39, 43-47, 49-52, 54-58, 60, 63-66, 68-72, 74-78, 80-83, 87-90, 92-93, 95-98, 100-104, 317-320, 323-324, 327-328, 331-332, 334-337, 342-343, 346-347, 350-351, 354-355, 358-359, 365-366. 370-371, 376-377, 380-381, 384-385, 388-389, 392-393 and 396-397) can comprise at least 65%, 70%, 75%, 80%, 85%, 90%, 91%, 92%, 93%, 94%, 95%, 96%, 97%, 98%, 99% or more sequence identity to the given DSB target site, wherein the active variants retain biological activity and hence are capable of being recognized and cleaved by an DSB-inducing-agent. Assays to measure the double-strand break of a DSB target site by an endonuclease are known in the art and generally measure the ability of an endonuclease to cut the DSB target site.

Endonucleases are enzymes that cleave the phosphodiester bond within a polynucleotide chain, and include restriction endonucleases that cleave DNA at specific sites without damaging the bases. Restriction endonucleases include Type I, Type II, Type III, and Type IV endonucleases, which further include subtypes. In the Type land Type III systems, both the methylase and restriction activities are contained in a single complex. Restriction enzymes are further described and classified, for example in the REBASE database (webpage at rebase.neb.com; Roberts et al., (2003) *Nucleic Acids Res* 31:418-20), Roberts et al., (2003) *Nucleic Acids Res* 31:1805-12, and Belfort et al., (2002) in *Mobile DNA II*, pp. 761-783, Eds. Craigie et al., (ASM Press, Washington, DC).

Endonucleases also include meganucleases, also known as homing endonucleases (HEases), which like restriction endonucleases, bind and cut at a specific DSB target site, however the DSB target sites for meganucleases are typically longer, about 18 bp or more. Meganuclease domains, structure and function are known, see for example, Guhan and Muniyappa (2003) *Crit Rev Biochem Mol Biol* 38:199-248; Lucas et al., (2001) *Nucleic Acids Res* 29:960-9; Jurica and Stoddard, (1999) *Cell Mol Life Sci* 55:1304-26; Stoddard, (2006) *Q Rev Biophys* 38:49-95; and Moure et al., (2002) *Nat Struct Biol* 9:764. In some examples a naturally occurring variant, and/or engineered derivative meganuclease is used. Any meganuclease can be used herein, including, but not limited to, I-SceI, I-SceII, I-SceIII, I-SceIV, I-SceV, I-SceVI, I-SceVII, I-CeuI, I-CeuAIIP, I-CreI, I-CrepsbIP, I-CrepsbIIP, I-CrepsbIIIP, I-CrepsbIVP, I-TliI, I-PpoI, PI-PspI, F-SceI, F-SceII, F-SuvI, F-TevI, F-TevII, I-AmaI, I-AniI, I-ChuI, I-CmoeI, I-CpaI, I-CpaII, I-CsmI, I-CvuI, I-CvuAIP, I-DdiI, I-DdiII, I-DirI, I-DmoI, I-HmuI, I-HmuII, I-HsNIP, I-LlaI, I-MsoI, I-NaaI, I-NanI, I-NcIIP, I-NgrIP, I-NitI, I-NjaI, I-Nsp236IP, I-PakI, I-PboIP, I-PcuIP, I-PcuAI, I-PcuVI, I-PgrIP, I-PobIP, I-PorI, I-PorIIP, I-PbpIP, I-SpBetaIP, I-ScaI, I-SexIP, I-SneIP, I-SpomI, I-SpomCP, I-SpomIP, I-SpomIIP, I-SquIP, I-Ssp6803I, I-SthPhiJP, I-SthPhiST3P, I-SthPhiSTe3bP, I-TdeIP, I-TevI, 1-TevII, I-TevIII, I-UarAP, I-UarHGPAIP, I-UarHGPA13P, I-VinIP, I-ZbiIP, PI-MtuI, PI-MtuHIP PI-MtuHIIP, PI-PfuI, PI-PfuII, PI-PkoI, PI-PkoII, PI-Rma43812IP, PI-SpBetaIP, PI-SceI, PI-TfuI, PI-TfuII, PI-ThyI, PI-TliI, PI-TliII, or any active variants or fragments thereof.

TAL effector nucleases can be used to make double-strand breaks at specific target sequences in the genome of a plant or other organism. TAL effector nucleases can be created by fusing a native or engineered transcription activator-like (TAL) effector, or functional part thereof, to the catalytic domain of an endonuclease, such as, for example, FokI. The unique, modular TAL effector DNA binding domain allows for the design of proteins with potentially any given DNA recognition specificity. Thus, the DNA binding domains of the TAL effector nucleases can be engineered to recognize specific DNA target sites and thus, used to make double-strand breaks at desired target sequences. See, WO 2010/079430; Morbitzer et al. (2010) *PNAS* 10.1073/pnas.1013133107; Scholze & Boch (2010) Virulence 1:428-432; Christian et al. *Genetics* (2010) 186:757-761; Li et al. (2010) *Nuc. Acids Res*. (2010) doi:10.1093/nar/gkq704; and Miller et al. (2011) *Nature Biotechnology* 29:143-148; all of which are herein incorporated by reference.

CRISPR loci (Clustered Regularly Interspaced Short Palindromic Repeats) (also known as SPIDRs-SPacer Interspersed Direct Repeats) constitute a family of recently described DNA loci. CRISPR loci consist of short and highly conserved DNA repeats (typically 24 to 40 bp, repeated from 1 to 140 times—also referred to as CRISPR-repeats) which are partially palindromic. The repeated sequences (usually specific to a species) are interspaced by variable sequences of constant length (typically 20 to 58 by depending on the CRISPR locus (WO2007/025097 published Mar. 1, 2007). CRISPR loci were first recognized in *E. coli* (Ishino et al. (1987) J. Bacterial. 169:5429-5433; Nakata et al. (1989) J. Bacterial. 171:3553-3556). Similar interspersed short sequence repeats have been identified in *Haloferax mediterranei, Streptococcus pyogenes, Anabaena,* and *Mycobacterium tuberculosis* (Groenen et al. (1993) Mol. Microbiol. 10:1057-1065; Hoe et al. (1999) Emerg. Infect. Dis. 5:254-263; Masepohl et al. (1996) Biochim. Biophys. Acta 1307:26-30; Mojica et al. (1995) Mol. Microbiol. 17:85-93). The CRISPR loci differ from other SSRs by the structure of the repeats, which have been termed short regularly spaced repeats (SRSRs) (Janssen et al. (2002) OMICS J. Integ. Biol. 6:23-33; Mojica et al. (2000) Mol. Microbiol. 36:244-246). The repeats are short elements that occur in clusters, that are always regularly spaced by variable sequences of constant length (Mojica et al. (2000) Mol. Microbiol. 36:244-246).

Cas gene relates to a gene that is generally coupled, associated or close to or in the vicinity of flanking CRISPR loci. The terms "Cas gene", "CRISPR-associated (Cas) gene" are used interchangeably herein. A comprehensive review of the Cas protein family is presented in Haft et al. (2005) Computational Biology, PLoS Comput Biol 1(6): e60. doi:10.1371/journal.pcbi.0010060. As described therein, 41 CRISPR-associated (Cas) gene families are described, in addition to the four previously known gene families. It shows that CRISPR systems belong to different classes, with different repeat patterns, sets of genes, and species ranges. The number of Cas genes at a given CRISPR locus can vary between species.

Cas endonuclease relates to a Cas protein encoded by a Cas gene, wherein said Cas protein is capable of introducing a double strand break into a DNA target sequence. The Cas endonuclease is guided by a guide polynucleotide to recognize and optionally introduce a double strand break at a specific target site into the genome of a cell (U.S. Provisional Application No. 62/023,239, filed Jul. 11, 2014). The guide polynucleotide/Cas endonuclease system includes a complex of a Cas endonuclease and a guide polynucleotide that is capable of introducing a double strand break into a DNA target sequence. The Cas endonuclease unwinds the DNA duplex in close proximity of the genomic target site and cleaves both DNA strands upon recognition of a target sequence by a guide RNA if a correct protospacer-adjacent motif (PAM) is approximately oriented at the 3' end of the target sequence.

The Cas endonuclease gene can be Cas9 endonuclease, or a functional fragment thereof, such as but not limited to, Cas9 genes listed in SEQ ID NOs: 462, 474, 489, 494, 499, 505, and 518 of WO2007/025097 published Mar. 1, 2007. The Cas endonuclease gene can be any Cas9 endonuclease of a *Streptococcus pyogenes*, a *Streptococcus thermophilus*, an *Streptococcus agalactiae* or a *Streptococcus mutans*, such as but not limited to SEQ ID Nos: 571-575. The Cas endonuclease gene can be a plant, maize or soybean optimized Cas9 endonuclease, such as but not limited to a plant codon optimized *Streptococcus pyogenes* Cas9 gene that can recognize any genomic sequence of the form N(12-30)NGG. The Cas endonuclease can be introduced directly into a cell by any method known in the art, for example, but not limited to transient introduction methods, transfection and/or topical application.

In one embodiment, the DSB target site is a Cas9 endonuclease target site selected from the group consisting of SEQ ID NOs: 3-5, 7-11, 13-19, 21-23, 25-28, 30-34, 36-39, 43-47, 49-52, 54-58, 60, 63-66, 68-72, 74-78, 80-83, 87-90, 92-93, 95-98, 100-104, 317-320, 323-324, 327-328, 331-332, 334-337, 342-343, 346-347, 350-351, 354-355, 358-359, 365-366, 370-371, 376-377, 380-381, 384-385, 388-389, 392-393 and 396-397.

In one embodiment, the composition is plant, plant part or seed having in its genome a genomic window comprising at least one transgenic target site for site specific integration (SSI) integrated into at least one Cas9 endonuclease target site, wherein said genomic window is flanked by at least a first and a second marker. The plant can be, but is not limited to, a soybean or maize plant having any genomic window described herein.

In one embodiment, the plant is a soybean plant, soybean plant part or soybean seed having in its genome a genomic window comprising at least one transgenic target site for site specific integration integrated into at least one Cas9 endonuclease target site, wherein said at least one transgenic target site is genetically linked to at least a first genetic marker and a second genetic marker, wherein said first genetic marker is selected from the group consisting of BARC_1.01_Gm01_6984873_T_C, BARC_0.01_Gm01_7775299_G_A, BARC_1.01_Gm01_7856395_A_C, BARC_01_Gm01_8569887_A_G, BARC_1.01_Gm01_8601858_C_T, BARC_01_Gm01_8641430_C_T, BARC_1.01_Gm01_8674202_A_C, BARC_0.01_Gm01_8933345_C_T, BARC_1.01_Gm01_8964201_T_C, BARC_0.01_Gm01_9014216_T_G, BARC_1.01_Gm01_28179606_A_G, BARC_1.01_Gm01_28364595_A_G, BARC_1.01_Gm01_28536363_G_A, BARC_1.01_Gm01_28599526_G_A, BARC_1.01_Gm01_28913996_A_G, BARC_1.01_Gm01_29284158_A_G, BARC_1.01_Gm01_31202345_C_T, BARC_1.01_Gm01_31770743_C_T, BARC_1.01_Gm01_32683433_G_A, or BARC_1.01_Gm01_34327255_C_T; and said second genetic marker is selected from the group consisting of BARC_1.01_Gm01_7775299_G_A, BARC_1.01_Gm01_7856395_A_C, BARC_1.01_Gm01_8569887_A_G, BARC_1.01_Gm01_8601858_C_T, BARC_1.01_Gm01_8641430_C_T, BARC_1.01_Gm01_8674202_A_C, BARC_1.01_Gm01_8933345_C_T, BARC_1.01_Gm01_8964201_T_C, BARC_1.01_Gm01_9014216_T_G, BARC_1.01_Gm01_28179606_A_G, BARC_1.01_Gm01_28364595_A_G, BARC_1.01_Gm01_28536363_G_A, BARC_1.01_Gm01_28599526_G_A, BARC_1.01_Gm01_28913996_A_G, BARC_1.01_Gm01_29284158_A_G, BARC_1.01_Gm01_31202345_C_T, BARC_1.01_Gm01_31770743_C_T, BARC_1.01_Gm01_32683433_G_A, BARC_1.01_Gm01_34327255_C_T, or BARC_1.01_Gm01_36994849_A_G.

In one embodiment, the plant is a soybean plant, soybean plant part or soybean seed having in its genome a genomic window comprising at least one transgenic target site for site specific integration integrated into at least one Cas9 endonuclease target site, wherein said at least one transgenic target site is genetically linked to at least a first genetic marker and a second genetic marker, wherein said first genetic marker is located between Gm01:6984873 and Gm01:34327255 on the soybean physical map, wherein said second genetic marker is located between Gm01:7775299 and Gm01:36994849 on the soybean physical map.

In one embodiment, the plant is a maize plant, maize plant part or maize seed having in its genome a genomic window comprising at least one transgenic target site for site specific integration (SSI) integrated into at least one Cas9 endonuclease target site, wherein said genomic window is flanked by at least a first and a second marker selected from the group consisting of: SYN12545, SYN12536, SYN14645, PZE-101023852, PZE-101024424, SYN25022, SYN31156, SYN31166, SYN22238 or SYN20196, PZE-101205031, PUT-163A-148951459-517, PZE-101205904, PZE-101206569 or SYN24492, PZE-103000166, PZE-103000238, PZE-103000307, SYN6355 or PZE-103001421, PZE-110099037, PZE-110099048, PZE-110100195, PZE-110100685 and PZE-110101412.

In one embodiment, the plant is a soybean plant, soybean plant part or soybean seed having in its genome a genomic window comprising at least one transgenic target site for site specific integration (SSI) integrated into at least one Cas9 endonuclease target site, wherein said genomic window is flanked by at least a first and a second marker selected from the group consisting of:
BARC_1.01_Gm04_45591011_C_T,
BARC_1.01_Gm04_45613405_T_C,
BARC_1.01_Gm04_45697256_G_A,
BARC_0.01_Gm04_45739051_A_C,
BARC_1.01_Gm04_45800267_T_C,
BARC_0.01_Gm04_45857325_T_C,
BARC_1.01_Gm04_45857325_T_C,
BARC_0.01_Gm04_45883080_A_G,
BARC_1.01_Gm04_45903617_T_C,
BARC_0.01_Gm04_46000185_C_A or
BARC_1.01_Gm04_46113406_T_G,
BARC_1.01_Gm06_46915875_T_C,
BARC_1.01_Gm06_47524452_G_T,
BARC_0.01_Gm06_47561262_C_T,
BARC_1.01_Gm06_47625670_C_T,
BARC_0.01_Gm06_47631544_T_C,
BARC_1.01_Gm06_47789229_C_T,
BARC_0.01_Gm06_47821576_T_G,
BARC_1.01_Gm06_47829363_A_C,
BARC_0.01_Gm06_47833095_A_G,
BARC_1.01_Gm06_47847021_G_T,
BARC_0.01_Gm06_47895876_G_A,
BARC_1.01_Gm06_48221293_T_C or
BARC_1.01_Gm06_48528885_G_T,
BARC_1.01_Gm01_6984873_T_C,
BARC_0.01_Gm01_7775299_G_A,
BARC_1.01_Gm01_7856395_A_C,
BARC_1.01_Gm01_8569887_A_G,
BARC_1.01_Gm01_8601858_C_T,
BARC_1.01_Gm01_8641430_C_T,
BARC_1.01_Gm01_8674202_A_C,
BARC_1.01_Gm01_8933345_C_T,
BARC_1.01_Gm01_8964201_T_C,
BARC_1.01_Gm01_9014216_T_G,
BARC_1.01_Gm01_28179606_A_G,
BARC_0.01_Gm01_28364595_A_G,
BARC_1.01_Gm01_28536363_G_A,
BARC_0.01_Gm01_28599526_G_A,
BARC_1.01_Gm01_28913996_A_G,
BARC_0.01_Gm01_29284158_A_G,
BARC_1.01_Gm01_31202345_C_T,
BARC_0.01_Gm01_31770743_C_T,
BARC_1.01_Gm01_32683433_G_A,
BARC_0.01_Gm01_34327255_C_T and
BARC_1.01_Gm01_36994849_A_G.

In one embodiment, the plant is a soybean or maize plant, wherein the genomic window described herein is not more than 0.1, 0.2, 0.3, 0.4, 0.5, 1, 2, 5, 10 cM in length.

In one embodiment, the plant is a soybean or maize plant, wherein the genomic window comprises a transgene, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

In one embodiment, the plant is a soybean or maize plant, wherein the genomic window comprises further comprises at least a second, third, fourth, fifth, sixth, seventh, eighth, ninth, tenth, eleventh, twelfth, thirteenth, fourteenth, fifteenth, or sixteenth transgenic target site for site specific integration integrated into at least a second, third, fourth, fifth, sixth, seventh, eighth, ninth, tenth, eleventh, twelfth, thirteenth, fourteenth, fifteenth, or sixteenth double-strand-break target site.

In one embodiment, the plant is a soybean or maize plant, wherein the genomic window comprises at least one transgenic SSI target site integrated in a Cas9 endonuclease site, wherein said at least one transgenic target site for site specific integration comprises a first recombination site and a second recombination site, wherein said first and said second recombination site are dissimilar with respect to one another.

In one embodiment, the plant is a soybean or maize plant, wherein the genomic window comprises at least one transgenic SSI target site integrated in a Cas9 endonuclease site, wherein said at least one transgenic target site for site specific integration further comprises a polynucleotide of interest flanked by said first recombination site and said second recombination site.

As used herein, the term "guide polynucleotide", relates to a polynucleotide sequence that can form a complex with a Cas endonuclease (such as but not limited to a Cas9 endonuclease) and enables the Cas endonuclease to recognize and optionally cleave a DNA target site (U.S. Provisional Application No. 62/023,239, filed Jul. 11, 2014). The guide polynucleotide can be a single molecule or a double molecule. The guide polynucleotide sequence can be a RNA sequence, a DNA sequence, or a combination thereof (a RNA-DNA combination sequence). Optionally, the guide polynucleotide can comprise at least one nucleotide, phosphodiester bond or linkage modification such as, but not limited, to Locked Nucleic Acid (LNA), 5-methyl dC, 2,6-Diaminopurine, 2'-Fluoro A, 2'-Fluoro U, 2'-O-Methyl RNA, phosphorothioate bond, linkage to a cholesterol molecule, linkage to a polyethylene glycol molecule, linkage to a spacer 18 (hexaethylene glycol chain) molecule, or 5' to 3' covalent linkage resulting in circularization. A guide polynucleotide that solely comprises of ribonucleic acids is also referred to as a "guide RNA". A guide RNA can include a fusion of two RNA molecules, a crRNA (CRISPR RNA) comprising a variable targeting domain, and a tracrRNA. In one embodiment, the guide RNA comprises a variable targeting domain of 12 to 30 nucleotide sequences and a RNA fragment that can interact with a Cas endonuclease.

The guide polynucleotide can be a double molecule (also referred to as duplex guide polynucleotide) comprising a first nucleotide sequence domain (referred to as Variable Targeting domain or VT domain) that is complementary to a nucleotide sequence in a target DNA and a second nucleotide sequence domain (referred to as Cas endonuclease recognition domain or CER domain) that interacts with a Cas endonuclease polypeptide. The CER domain of the double molecule guide polynucleotide comprises two separate molecules that are hybridized along a region of complementarity. The two separate molecules can be RNA, DNA, and/or RNA-DNA-combination sequences. In some embodiments, the first molecule of the duplex guide polynucleotide comprising a VT domain linked to a CER domain is referred to as "crDNA" (when composed of a contiguous stretch of DNA nucleotides) or "crRNA" (when composed of a contiguous stretch of RNA nucleotides), or "crDNA-RNA" (when composed of a combination of DNA and RNA nucleotides). The crNucleotide can comprise a fragment of the cRNA naturally occurring in Bacteria and Archaea. In one embodiment, the size of the fragment of the cRNA naturally occurring in Bacteria and Archaea that is present in a crNucleotide disclosed herein can range from, but is not limited to, 2, 3, 4, 5, 6, 7, 8, 9, 10, 11, 12, 13, 14, 15, 16, 17, 18, 19, 20 or more nucleotides. In some embodiments the second molecule of the duplex guide polynucleotide comprising a CER domain is referred to as "tracrRNA" (when composed of a contiguous stretch of RNA nucleotides) or "tracrDNA" (when composed of a contiguous stretch of DNA nucleotides) or "tracrDNA-RNA" (when composed of a combination of DNA and RNA nucleotides In one embodiment, the RNA that guides the RNA/Cas9 endonuclease complex, is a duplexed RNA comprising a duplex crRNA-tracrRNA.

The guide polynucleotide can also be a single molecule comprising a first nucleotide sequence domain (referred to as Variable Targeting domain or VT domain) that is complementary to a nucleotide sequence in a target DNA and a second nucleotide domain (referred to as Cas endonuclease recognition domain or CER domain) that interacts with a Cas endonuclease polypeptide. By "domain" it is meant a contiguous stretch of nucleotides that can be RNA, DNA, and/or RNA-DNA-combination sequence. The VT domain and/or the CER domain of a single guide polynucleotide can comprise a RNA sequence, a DNA sequence, or a RNA-DNA-combination sequence. In some embodiments the single guide polynucleotide comprises a crNucleotide (comprising a VT domain linked to a CER domain) linked to a tracrNucleotide (comprising a CER domain), wherein the linkage is a nucleotide sequence comprising a RNA sequence, a DNA sequence, or a RNA-DNA combination sequence. The single guide polynucleotide being comprised of sequences from the crNucleotide and tracrNucleotide may be referred to as "single guide RNA" (when composed of a contiguous stretch of RNA nucleotides) or "single guide DNA" (when composed of a contiguous stretch of DNA nucleotides) or "single guide RNA-DNA" (when composed of a combination of RNA and DNA nucleotides). In one embodiment of the disclosure, the single guide RNA comprises a cRNA or cRNA fragment and a tracrRNA or tracrRNA fragment of the type II CRISPR/Cas system that can form a complex with a type II Cas endonuclease, wherein said guide RNA/Cas endonuclease complex can direct the Cas endonuclease to a plant genomic target site, enabling the Cas endonuclease to introduce a double strand break into the genomic target site. One aspect of using a single guide polynucleotide versus a duplex guide polynucleotide is that only one expression cassette needs to be made to express the single guide polynucleotide.

The term "variable targeting domain" or "VT domain" is used interchangeably herein and includes a nucleotide sequence that is complementary to one strand (nucleotide sequence) of a double strand DNA target site. The % complementation between the first nucleotide sequence domain (VT domain) and the target sequence can be at least 50%, 51%, 52%, 53%, 54%, 55%, 56%, 57%, 58%, 59%, 60%, 61%, 62%, 63%, 63%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100%. The variable target domain can be at least 12, 13, 14, 15, 16, 17, 18, 19, 20, 21, 22, 23, 24, 25, 26, 27, 28, 29 or 30 nucleotides in length. In some embodiments, the variable targeting domain comprises a contiguous stretch of 12 to 30 nucleotides. The variable targeting domain can be composed of a DNA sequence, a RNA sequence, a modified DNA sequence, a modified RNA sequence, or any combination thereof.

The term "Cas endonuclease recognition domain" or "CER domain" of a guide polynucleotide is used interchangeably herein and includes a nucleotide sequence (such as a second nucleotide sequence domain of a guide polynucleotide), that interacts with a Cas endonuclease polypeptide. The CER domain can be composed of a DNA sequence, a RNA sequence, a modified DNA sequence, a modified RNA sequence (see for example modifications described herein), or any combination thereof.

The nucleotide sequence linking the crNucleotide and the tracrNucleotide of a single guide polynucleotide can comprise a RNA sequence, a DNA sequence, or a RNA-DNA combination sequence. In one embodiment, the nucleotide sequence linking the crNucleotide and the tracrNucleotide of a single guide polynucleotide can be at least 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 78, 79, 80, 81, 82, 83, 84, 85, 86, 87, 88, 89, 90, 91, 92, 93, 94, 95, 96, 97, 98, 99 or 100 nucleotides in length. In another embodiment, the nucleotide sequence linking the crNucleotide and the tracrNucleotide of a single guide polynucleotide can comprise a tetraloop sequence, such as, but not limiting to a GAAA tetraloop sequence.

Nucleotide sequence modification of the guide polynucleotide, VT domain and/or CER domain can be selected from, but not limited to, the group consisting of a 5' cap, a 3' polyadenylated tail, a riboswitch sequence, a stability control sequence, a sequence that forms a dsRNA duplex, a modification or sequence that targets the guide poly nucleotide to a subcellular location, a modification or sequence that provides for tracking, a modification or sequence that provides a binding site for proteins, a Locked Nucleic Acid (LNA), a 5-methyl dC nucleotide, a 2,6-Diaminopurine nucleotide, a 2'-Fluoro A nucleotide, a 2'-Fluoro U nucleotide; a 2'-O-Methyl RNA nucleotide, a phosphorothioate bond, linkage to a cholesterol molecule, linkage to a polyethylene glycol molecule, linkage to a spacer 18 molecule, a 5' to 3' covalent linkage, or any combination thereof. These modifications can result in at least one additional beneficial feature, wherein the additional beneficial feature is selected from the group of a modified or regulated stability, a subcellular targeting, tracking, a fluorescent label, a binding site for a protein or protein complex, modified binding affinity to complementary target sequence, modified resistance to cellular degradation, and increased cellular permeability.

The DSB-inducing agent can be provided via a polynucleotide encoding the nuclease. Such a polynucleotide encoding a nuclease can be modified to substitute codons having a higher frequency of usage in a plant, as compared to the naturally occurring polynucleotide sequence. For example the polynucleotide encoding the DSB-inducing agent can be modified to substitute codons having a higher frequency of usage in a maize or soybean plant, as compared to the naturally occurring polynucleotide sequence.

Active variants and fragments of DSB-inducing agent i.e. an engineered endonuclease) can comprise at least 65%, 70%, 75%, 80%, 85%, 90%, 91%, 92%, 93%, 94%, 95%, 96%, 97%, 98%, 99% or more sequence identity to the native endonuclease, wherein the active variants retain the ability to cut at a desired DSB target site and hence retain double-strand-break-inducing activity. Assays for double-strand-break-inducing activity are known and generally measure the overall activity and specificity of the endonuclease on DNA substrates containing the DSB target site.

The DSB-inducing agent may be introduced by any means known in the art. For example, a plant having the DSB target site in its genome is provided. The DSB-inducing agent may be transiently expressed or the polypeptide itself can be directly provided to the cell. Alternatively, a nucleotide sequence capable of expressing the DSB-inducing agent may be stably integrated into the genome of the plant. In the presence of the corresponding DSB target site and the DSB-inducing agent, the donor DNA is inserted into the transformed plant's genome. Alternatively, the components of the system may be brought together by sexually crossing transformed plants. Thus a sequence encoding the DSB-inducing agent and/or target site can be sexually crossed to one another to allow each component of the system to be present in a single plant. The DSB-inducing agent may be under the control of a constitutive or inducible promoter. Such promoters of interest are discussed in further detail elsewhere herein.

Methods and compositions are provided herein which establish and use plants, plant parts, plant cells and seeds having stably incorporated into their genome a transgenic target site for site-specific integration (also referred to as transgenic SSI target site) where the transgenic SSI target site is integrated into the target site of a DSB-inducing agent. As used herein, a transgenic SSI target site is "integrated" into a DSB target site when a DSB-inducing agent induces a double-strand break in the DSB target site and a homologous recombination event thereby inserts the transgenic SSI target site within the boundaries of the original DSB target site (see for example FIG. 2A-2D). It is recognized that the position within a given DSB target site in which the transgenic SSI target integrates will vary depending on where the double strand break is induced by the DSB-inducing agent. The sequence of the DSB target site need not immediately flank the boundaries of the transgenic SSI target. For example, sequences 5' and 3' to the transgenic SSI target found on the donor DNA may also be integrated into the DSB target site.

As outlined above, plants, plant cells and seeds having a transgenic SSI target site integrated at a DSB target site are provided.

In one embodiment, the composition is a plant, plant part or seed having in its genome at least one transgenic target site for site specific integration (SSI) integrated into at least one Cas endonuclease target site. In one embodiment, the Cas endonuclease target site is a Cas9 endonuclease target site. In one embodiment, the plant is a monocot or a dicot.

Various methods can be used to integrate the transgenic SSI target site at the DSB target site. Such methods employ homologous recombination to provide integration of the transgenic SSI target site at the endonuclease DSB target site. In the methods provided herein, the transgenic SSI target site is provided to the plant cell in a donor DNA construct. A "donor DNA" (also referred to as Repair DNA) can include a DNA construct that comprises a transgenic SSI target site for site-specific integration. The donor DNA construct can further comprise a first and a second region of homology that flank the transgenic SSI target site sequence (see for example FIG. 2B). The first and second regions of homology of the donor DNA share homology to a first and a second genomic region, respectively, present in or flanking the DSB target site of the plant genome. By "homology" is meant DNA sequences that are similar. For example, a "region of homology to a genomic region" that is found on the donor DNA is a region of DNA that has a similar sequence to a given "genomic region" in the plant genome. A region of homology can be of any length that is sufficient to promote homologous recombination at the cleaved DSB target site. For example, the region of homology can comprise at least 5-10, 5-15, 5-20, 5-25, 5-30, 5-35, 5-40, 5-45, 5-50, 5-55, 5-60, 5-65, 5-70, 5-75, 5-80, 5-85, 5-90, 5-95, 5-100, 5-200, 5-300, 5-400, 5-500, 5-600, 5-700, 5-800, 5-900, 5-1000, 5-1100, 5-1200, 5-1300, 5-1400, 5-1500, 5-1600, 5-1700, 5-1800, 5-1900, 5-2000, 5-2100, 5-2200, 5-2300, 5-2400, 5-2500, 5-2600, 5-2700, 5-2800. 5-2900, 5-3000, 5-3100 or more bases in length such that the region of homology has sufficient homology to undergo homologous recombination with the corresponding genomic region. "Sufficient homology" indicates that two polynucleotide sequences have sufficient structural similarity to act as substrates for a homologous recombination reaction.

As used herein, a "genomic region" is a segment of a chromosome in the genome of a plant cell that is present on either side of the DSB target site or, alternatively, also comprises a portion of the DSB target site. The genomic region can comprise at least 5-10, 5-15, 5-20, 5-25, 5-30, 5-35, 5-40, 5-45, 5-50, 5-55, 5-60, 5-65, 5-70, 5-75, 5-80, 5-85, 5-90, 5-95, 5-100, 5-200, 5-300, 5-400, 5-500, 5-600, 5-700, 5-800, 5-900, 5-1000, 5-1100, 5-1200, 5-1300, 5-1400, 5-1500, 5-1600, 5-1700, 5-1800, 5-1900, 5-2000, 5-2100, 5-2200, 5-2300, 5-2400, 5-2500, 5-2600, 5-2700, 5-2800. 5-2900, 5-3000, 5-3100 or more bases such that the genomic region has sufficient homology to undergo homologous recombination with the corresponding region of homology.

The structural similarity between a given genomic region and the corresponding region of homology found on the donor DNA can be any degree of sequence identity that allows for homologous recombination to occur. For example, the amount of homology or sequence identity shared by the "region of homology" of the donor DNA and the "genomic region" of the plant genome can be at least 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity, such that the sequences undergo homologous recombination.

The region of homology on the donor DNA can have homology to any sequence flanking the DSB target site. While in some embodiments the regions of homology share significant sequence homology to the genomic sequence immediately flanking the target site, it is recognized that the regions of homology can be designed to have sufficient homology to regions that may be further 5' or 3' to the DSB target site. In still other embodiments, the regions of homology can also have homology with a fragment of the DSB target site along with downstream genomic regions. In one embodiment, the first region of homology further comprises a first fragment of the DSB target site and the second region of homology comprises a second fragment of the DSB target site, wherein the first and second fragments are dissimilar.

Homologous recombination includes the exchange of DNA fragments between two DNA molecules at the sites of homology. The frequency of homologous recombination is influenced by a number of factors. Different organisms vary with respect to the amount of homologous recombination and the relative proportion of homologous to non-homologous recombination. Generally, the length of the region of homology affects the frequency of homologous recombination events, the longer the region of homology, the greater the frequency. The length of the homology region needed to observe homologous recombination is also species-variable. In many cases, at least 5 kb of homology has been utilized, but homologous recombination has been observed with as little as 25-50 bp of homology. See, for example, Singer et al., (1982) *Cell* 31:25-33; Shen and Huang, (1986) *Genetics* 112:441-57; Watt et al., (1985) *Proc. Natl. Acad. Sci. USA* 82:4768-72, Sugawara and Haber, (1992) *Mol Cell Biol* 12:563-75, Rubnitz and Subramani, (1984) *Mol Cell Biol* 4:2253-8; Ayares et al., (1986) *Proc. Natl. Acad. Sci. USA* 83:5199-203; Liskay et al., (1987) *Genetics* 115:161-7.

Once a double-strand break is induced in the DNA, the cell's DNA repair mechanism is activated to repair the break. Error-prone DNA repair mechanisms can produce mutations at double-strand break sites. The most common repair mechanism to bring the broken ends together is the nonhomologous end-joining (NHEJ) pathway (Bleuyard et al., (2006) *DNA Repair* 5:1-12). The structural integrity of chromosomes is typically preserved by the repair, but deletions, insertions, or other rearrangements are possible (Siebert and Puchta, (2002) *Plant Cell* 14:1121-31; Pacher et al., (2007) *Genetics* 175:21-9).

Alternatively, the double-strand break can be repaired by homologous recombination between homologous DNA sequences. Once the sequence around the double-strand break is altered, for example, by exonuclease activities involved in the maturation of double-strand breaks, gene conversion pathways can restore the original structure if a homologous sequence is available, such as a homologous chromosome in non-dividing somatic cells, or a sister chromatid after DNA replication (Molinier et al., (2004) *Plant Cell* 16:342-52). Ectopic and/or epigenic DNA sequences may also serve as a DNA repair template for homologous recombination (Puchta, (1999) *Genetics* 152:1173-81).

DNA double-strand breaks appear to be an effective factor to stimulate homologous recombination pathways (Puchta et al., (1995) *Plant Mol Biol* 28:281-92; Tzfira and White, (2005) *Trends Biotechnol* 23:567-9; Puchta, (2005) *J Exp Bot* 56:1-14). Using DNA-breaking agents, a two- to ninefold increase of homologous recombination was observed between artificially constructed homologous DNA repeats in plants (Puchta et al., (1995) *Plant Mol Biol* 28:281-92). In maize protoplasts, experiments with linear DNA molecules demonstrated enhanced homologous recombination between plasmids (Lyznik et al., (1991) *Mol Gen Genet* 230:209-18).

Once a double-strand break is introduced in the DSB target site by the DSB inducing agent (such as a Cas9 endonuclease), the first and second regions of homology of the donor DNA can undergo homologous recombination with their corresponding genomic regions of homology resulting in exchange of DNA between the donor and the genome. As such, the provided method results in the integration of the target site of the donor DNA into the double-strand break in the DSB target site in the plant genome (see for example FIG. 2 D).

The donor DNA may be introduced by any means known in the art. For example, a plant having a DSB target site is provided. The donor DNA may be provided by any transformation method known in the art including, for example, *Agrobacterium*-mediated transformation or biolistic particle bombardment. The donor DNA may be present transiently in the cell or it could be introduced via a viral replicon. In the presence of the DBS inducing agent and the DSB target site, the donor DNA is inserted into the transformed plant's genome.

In one embodiment, the method is a method for introducing into the genome of a plant cell a transgenic target site for site-specific integration, the method comprising: (a) providing a plant cell comprising in its genome an endogenous target site for a Cas endonuclease; (b) providing a Cas endonuclease and a guide polynucleotide, wherein the Cas endonuclease is capable of forming a complex with said guide polynucleotide, wherein said complex is capable of inducing a double-strand break in said endogenous target site, and wherein the endogenous target site is located between a first and a second genomic region; (c) providing a donor DNA comprising the transgenic target site for site-specific integration located between a first region of homology to said first genomic region and a second region of homology to said second genomic region, wherein the transgenic target site comprises a first and a second recombination site, wherein the first and the second recombination sites are dissimilar with respect to one another; (d) contacting the plant cell with the guide polynucleotide, the donor DNA and the Cas endonuclease; and, (e) identifying at least one plant cell from (d) comprising in its genome the transgenic target site integrated at said endogenous target site.

In one embodiment, the endogenous target site for a Cas endonuclease is selected from the group consisting of SEQ ID NO: 3-5, 7-11, 13-19, 21-23, 25-28, 30-34, 36-39, 43-47, 49-52, 54-58, 60, 63-66, 68-72, 74-78, 80-83, 87-90, 92-93, 95-98, 100-104, 436-439, 442-443, 446-447, 450-451, 453-456, 461-462, 465-466, 469-470, 473-474, 477-478, 484-485, 489-490, 495-496, 499-500, 503-504, 507-508, 511-512 and 515-516 or a functional fragment thereof.

As described in the previous section, the transgenic SSI target site can be provided in a donor DNA which undergoes homologous recombination with the genomic DNA at the cleaved DSB target site resulting in integration of the transgenic SSI target site into the genome of the plant cell.

The transgenic SSI target site can comprise various components. The terms "transgenic SSI target site", "transgenic target site for site specific integration (SSI)", and "transgenic target site for SSI" are used interchangeably herein and refer to a polynucleotide comprising a nucleotide sequence flanked by at least two recombination sites. In some embodiments, the recombination sites of the transgenic SSI target site are dissimilar and non-recombinogenic with respect to one another. One or more intervening sequences may be present between the recombination sites of the transgenic SSI target site. Intervening sequences of particular interest would include linkers, adapters, selectable markers, polynucleotides of interest, promoters and/or other sites that aid in vector construction or analysis. In addition, the recombination sites of the transgenic SSI target site can be located in various positions, including, for example, within intronic sequences, coding sequences, or untranslated regions.

The transgenic SSI target site can comprise 1, 2, 3, 4, 5, 6 or more recombination sites. In one embodiment, the transgenic SSI target site comprises a first recombination site and a second recombination site wherein the first and the second recombination site are dissimilar and non-recombinogenic to each other (see for example the transgenic SSI target site depicted in FIG. 2B). In a further embodiment, the transgenic SSI target site comprises a third recombination site between the first recombination site and the second recombination site. In such embodiments, the first, second and third recombination sites may be dissimilar and non-recombinogenic with respect to one another. Such first, second and third recombination sites are able to recombine with their corresponding or identical recombination site when provided with the appropriate recombinase. The various recombination sites and recombinases encompassed by the methods and compositions are described in detail elsewhere herein.

The recombination sites employed in the methods and compositions provided herein can be "corresponding" sites or "dissimilar" sites. By "corresponding recombination sites" or a "set of corresponding recombination sites" is intended that the recombination sites have the same or corresponding nucleotide sequence. A set of corresponding recombination sites, in the presence of the appropriate recombinase, will efficiently recombine with one another (i.e., the corresponding recombination sites are recombinogenic).

In other embodiments, the recombination sites are dissimilar. By "dissimilar recombination sites" or a "set of dissimilar recombination sites" is intended that the recombination sites are distinct (i.e., have at least one nucleotide difference).

The recombination sites within "a set of dissimilar recombination sites" can be either recombinogenic or non-recombinogenic with respect to one other. By "recombinogenic" is intended that the set of recombination sites are capable of recombining with one another. Thus, suitable sets of "recombinogenic" recombination sites for use in the methods and compositions provided herein include those sites where the relative excision efficiency of recombination between the recombinogenic sites is above the detectable limit under standard conditions in an excision assay, typically, greater than 2%, 5%, 10%, 20%, 50%, 100%, or greater.

By "non-recombinogenic" is intended the set of recombination sites, in the presence of the appropriate recombinase, will not recombine with one another or recombination between the sites is minimal. Thus, suitable "non-recombinogenic" recombination sites for use in the methods and compositions provided herein include those sites that recombine (or excise) with one another at a frequency lower than the detectable limit under standard conditions in an excision assay, typically, lower than 2%, 1.5%, 1%, 0.75%, 0.5%, 0.25%, 0.1%, 0.075, 0.005%, 0.001%.

Each recombination site within the "set of non-recombinogenic sites" is biologically active and therefore can recombine with an identical site. Accordingly, it is recognized that any suitable non-recombinogenic recombination sites may be utilized, including a FRT site or an active variant thereof, a LOX site or active variant thereof, any combination thereof, or any other combination of non-recombinogenic recombination sites known in the art. FRT sites that can be employed in the methods and compositions disclosed herein can be found, for example, in US Publication No. 2011-0047655, herein incorporated by reference.

In a specific embodiment, at least one of the first, the second and the third recombination site comprises FRT1 (SEQ ID NO: 576), FRT5 (SEQ ID NO: 577), FRT6 (SEQ ID NO: 578), FRT12 (SEQ ID NO: 579) or FRT87 (SEQ ID NO: 580). In a specific embodiment, the first recombination site is FRT1, the second recombination site is FRT12 and the third recombination site is FRT87.

The methods also comprise introducing into the plant cell comprising the integrated transgenic SSI target site a transfer cassette. The transfer cassette comprises various components for the incorporation of polynucleotides of interest into the plant genome. As defined herein, the "transfer cassette" comprises at least a first recombination site, a polynucleotide of interest, and a second recombination site, wherein the first and second recombination sites are dissimilar and non-recombinogenic and correspond to the recombination sites in the transgenic SSI target site. The transfer cassette is also immediately flanked by the recombination sites. It is recognized that any combination of restriction sites can be employed in the transfer cassettes to provide a polynucleotide of interest.

In one embodiment, the transfer cassette comprises the first recombination site, a first polynucleotide of interest, and the second recombination site. In such methods, the first and second recombination sites of the transfer cassette are recombinogenic (i.e. identical or corresponding) with the first and second recombination sites of the transgenic SSI target site, respectively.

The recombination sites of the transfer cassette may be directly contiguous with the polynucleotide of interest or there may be one or more intervening sequences present between one or both ends of the polynucleotide of interest and the recombination sites. Intervening sequences of particular interest would include linkers, adapters, additional polynucleotides of interest, markers, promoters and/or other sites that aid in vector construction or analysis. It is further recognized that the recombination sites can be contained within the polynucleotide of interest (i.e., such as within introns, coding sequence, or untranslated regions).

In a specific embodiment, the transfer cassette further comprises at least one coding region operably linked to a promoter that drives expression in the plant cell. As discussed elsewhere herein, a recombinase is provided that recognizes and implements recombination at the recombination sites of the transgenic SSI target site and the transfer cassette. The recombinase can be provided by any means known in the art and is described in detail elsewhere herein. In a specific embodiment, the coding region of the transfer cassette encodes a recombinase that facilitates recombination between the first and the second recombination sites of the transfer cassette and the transgenic SSI target site, the second and the third recombination sites of the transfer cassette and the transgenic SSI target site, or the first and the third recombination sites of the transfer cassette and the transgenic SSI target site.

Methods for selecting plant cells with integration at the transgenic SSI target site, such as selecting for cells expressing a selectable marker, are known in the art. As such, the methods further comprise recovering a fertile plant from the plant cell comprising in its genome the transfer cassette at the transgenic SSI target site.

Any polynucleotide of interest (i.e., the "polypeptide of interest") may be provided to the plant cells in the transfer cassettes, transgenic SSI target sites or directly in the DSB target sites of the methods disclosed herein. It is recognized that any polynucleotide of interest can be provided, integrated into the plant genome at the transgenic SSI target site by site-specific integration or directly into a DSB target site as described herein, and expressed in a plant. The methods disclosed herein, provide for at least 1, 2, 3, 4, 5, 6 or more polynucleotides of interest to be integrated into a specific site in the plant genome.

In one embodiment, the method is a method of integrating a polynucleotide of interest into a transgenic target site in the genome of a plant cell, the method comprising: (a) providing at least one plant cell comprising in its genome a transgenic target site for site-specific integration, wherein the transgenic target site is integrated into an endogenous target site for a Cas endonuclease, and wherein the transgenic target site is, (i) a target site comprising a first and a second recombination site; or (ii) the target site of (i) further comprising a third recombination site between the first recombination site and the second recombination site, wherein the Cas endonuclease is capable of inducing a double-strand break in the endogenous target site, wherein the first, the second, and the third recombination sites are dissimilar with respect to one another, (b) introducing into the plant cell of (a) a transfer cassette comprising, (iii) the first recombination site, a first polynucleotide of interest, and the second recombination site, (iv) the second recombination site, a second polynucleotide of interest, and the third recombination sites, or (v) the first recombination site, a third polynucleotide of interest, and the third recombination sites; (c) providing a recombinase that recognizes and implements recombination at the first and the second recombination sites, at the second and the third recombination sites, or at the first and third recombination sites; and (d) selecting at least one plant cell comprising integration of the transfer cassette at the target site.

In one embodiment, the method is a method of integrating a polynucleotide of interest into a plant having in its genome a genomic window comprising at least one Cas9 endonuclease target site, the method comprising: (a) providing at least one plant cell comprising a target site for a Cas endonuclease located in said genomic window, (b) providing a Cas endonuclease and a guide polynucleotide, wherein the Cas endonuclease is capable of forming a complex with said guide polynucleotide, wherein said complex is capable of inducing a double-strand break in said Cas9 endonuclease target site, and wherein the Cas9 endonuclease target site is located between a first and a second genomic region; (c) providing a donor DNA comprising a polynucleotide of interest located between a first region of homology to said first genomic region and a second region of homology to said second genomic region; (d) contacting the plant cell with the guide polynucleotide, the donor DNA and the Cas endonuclease; and, (e) identifying at least one plant cell from (d) comprising in its genome polynucleotide of interest integrated at said Cas9 endogenous target site.

Various changes in phenotype are of interest, including modifying the fatty acid (oil) composition in a plant, altering the amino acid content of a plant, altering a plant's pathogen defense mechanism, and the like. These results can be achieved by providing expression of heterologous products (i.e. polynucleotides of interest) or increased expression of endogenous products in plants. Alternatively, the results can be achieved by providing for a reduction of expression of one or more endogenous products, particularly enzymes or cofactors in the plant. These changes result in a change in phenotype of the transformed plant.

In one embodiment, at least one of the first, the second, and the third polynucleotides of interest comprises a nucleotide sequence for gene silencing, a nucleotide sequence encoding a phenotypic marker, or a nucleotide sequence encoding a protein providing an agronomic advantage.

Polynucleotides of interest are reflective of the commercial markets and interests of those involved in the development of the crop. Crops and markets of interest change, and as developing nations open up world markets, new crops and technologies will emerge also. In addition, as our understanding of agronomic traits and characteristics such as yield and heterosis increase, the choice of genes for transformation will change accordingly. Polynucleotides/polypeptides of interest include, but are not limited to, herbicide-tolerance coding sequences, insecticidal coding sequences, nematicidal coding sequences, antimicrobial coding sequences, antifungal coding sequences, antiviral coding sequences, abiotic and biotic stress tolerance coding sequences, or sequences modifying plant traits such as yield, grain quality, nutrient content, starch quality and quantity, nitrogen fixation and/or utilization, and oil content and/or composition. More specific polynucleotides of interest include, but are not limited to, genes that improve crop yield, polypeptides that improve desirability of crops, genes encoding proteins conferring resistance to abiotic stress, such as drought, nitrogen, temperature, salinity, toxic metals or trace elements, or those conferring resistance to toxins such as pesticides and herbicides, or to biotic stress, such as attacks by fungi, viruses, bacteria, insects, and nematodes, and development of diseases associated with these organisms.

An "herbicide resistance protein" or a protein resulting from expression of an "herbicide resistance-encoding nucleic acid molecule" includes proteins that confer upon a cell the ability to tolerate a higher concentration of an herbicide than cells that do not express the protein, or to tolerate a certain concentration of an herbicide for a longer period of time than cells that do not express the protein. Herbicide resistance traits may be introduced into plants by genes coding for resistance to herbicides that act to inhibit the action of acetolactate synthase (ALS), in particular the sulfonylurea-type herbicides, genes coding for resistance to herbicides that act to inhibit the action of glutamine synthase, such as phosphinothricin or basta (e.g., the bar gene), glyphosate (e.g., the EPSP synthase gene and the GAT gene), HPPD inhibitors (e.g, the HPPD gene) or other such genes known in the art. See, for example, U.S. Pat. Nos. 7,626,077, 5,310,667, 5,866,775, 6,225,114, 6,248,876, 7,169,970, 6,867,293, and U.S. Provisional Application No. 61/401,456, each of which is herein incorporated by reference.

Agronomically important traits such as oil, starch, and protein content can be genetically altered in addition to using traditional breeding methods. Modifications include increasing content of oleic acid, saturated and unsaturated oils, increasing levels of lysine and sulfur, providing essential amino acids, and also modification of starch. Hordothionin protein modifications are described in U.S. Pat. Nos. 5,703,049, 5,885,801, 5,885,802, and 5,990,389, herein incorporated by reference. Another example is lysine and/or sulfur rich seed protein encoded by the soybean 2S albumin described in U.S. Pat. No. 5,850,016, and the chymotrypsin inhibitor from barley, described in Williamson et al. (1987) *Eur. J. Biochem.* 165:99-106, the disclosures of which are herein incorporated by reference.

Commercial traits can also be encoded on a polynucleotide of interest that could increase for example, starch for ethanol production, or provide expression of proteins. Another important commercial use of transformed plants is the production of polymers and bioplastics such as described in U.S. Pat. No. 5,602,321. Genes such as β-Ketothiolase, PHBase (polyhydroxyburyrate synthase), and acetoacetyl-CoA reductase (see Schubert et al. (1988) *J. Bacteriol.* 170:5837-5847) facilitate expression of polyhyroxyalkanoates (PHAs).

Derivatives of the coding sequences can be made by site-directed mutagenesis to increase the level of preselected amino acids in the encoded polypeptide. For example, the gene encoding the barley high lysine polypeptide (BHL) is derived from barley chymotrypsin inhibitor, U.S. application Ser. No. 08/740,682, filed Nov. 1, 1996, and WO 98/20133, the disclosures of which are herein incorporated by reference. Other proteins include methionine-rich plant proteins such as from sunflower seed (Lilley et al. (1989) Proceedings of the *World Congress on Vegetable Protein*

*Utilization in Human Foods and Animal Feedstuffs*, ed. Applewhite (American Oil Chemists Society, Champaign, Ill.), pp. 497-502; herein incorporated by reference); corn (Pedersen et al. (1986) *J. Biol. Chem.* 261:6279; Kirihara et al. (1988) *Gene* 71:359; both of which are herein incorporated by reference); and rice (Musumura et al. (1989) *Plant Mol. Biol.* 12:123, herein incorporated by reference). Other agronomically important genes encode latex, Floury 2, growth factors, seed storage factors, and transcription factors. Polynucleotides that improve crop yield include dwarfing genes, such as Rht1 and Rht2 (Peng et al. (1999) *Nature* 400:256-261), and those that increase plant growth, such as ammonium-inducible glutamate dehydrogenase. Polynucleotides that improve desirability of crops include, for example, those that allow plants to have reduced saturated fat content, those that boost the nutritional value of plants, and those that increase grain protein. Polynucleotides that improve salt tolerance are those that increase or allow plant growth in an environment of higher salinity than the native environment of the plant into which the salt-tolerant gene(s) has been introduced.

Polynucleotides/polypeptides that influence amino acid biosynthesis include, for example, anthranilate synthase (AS; EC 4.1.3.27) which catalyzes the first reaction branching from the aromatic amino acid pathway to the biosynthesis of tryptophan in plants, fungi, and bacteria. In plants, the chemical processes for the biosynthesis of tryptophan are compartmentalized in the chloroplast. See, for example, US Pub. 20080050506, herein incorporated by reference. Additional sequences of interest include Chorismate Pyruvate Lyase (CPL) which refers to a gene encoding an enzyme which catalyzes the conversion of chorismate to pyruvate and pHBA. The most well characterized CPL gene has been isolated from *E. coli* and bears the GenBank accession number M96268. See, U.S. Pat. No. 7,361,811, herein incorporated by reference.

These polynucleotide sequences of interest may encode proteins involved in providing disease or pest resistance. By "disease resistance" or "pest resistance" is intended that the plants avoid the harmful symptoms that are the outcome of the plant-pathogen interactions. Pest resistance genes may encode resistance to pests that have great yield drag such as rootworm, cutworm, European Corn Borer, and the like. Disease resistance and insect resistance genes such as lysozymes or cecropins for antibacterial protection, or proteins such as defensins, glucanases or chitinases for antifungal protection, or *Bacillus thuringiensis* endotoxins, protease inhibitors, collagenases, lectins, or glycosidases for controlling nematodes or insects are all examples of useful gene products. Genes encoding disease resistance traits include detoxification genes, such as against fumonosin (U.S. Pat. No. 5,792,931); avirulence (avr) and disease resistance (R) genes (Jones et al. (1994) *Science* 266:789; Martin et al. (1993) *Science* 262:1432; and Mindrinos et al. (1994) *Cell* 78:1089); and the like.

Furthermore, it is recognized that the polynucleotide of interest may also comprise antisense sequences complementary to at least a portion of the messenger RNA (mRNA) for a targeted gene sequence of interest. Antisense nucleotides are constructed to hybridize with the corresponding mRNA. Modifications of the antisense sequences may be made as long as the sequences hybridize to and interfere with expression of the corresponding mRNA. In this manner, antisense constructions having 70%, 80%, or 85% sequence identity to the corresponding antisense sequences may be used. Furthermore, portions of the antisense nucleotides may be used to disrupt the expression of the target gene. Generally, sequences of at least 50 nucleotides, 100 nucleotides, 200 nucleotides, or greater may be used.

In addition, the polynucleotide of interest may also be used in the sense orientation to suppress the expression of endogenous genes in plants. Methods for suppressing gene expression in plants using polynucleotides in the sense orientation are known in the art. The methods generally involve transforming plants with a DNA construct comprising a promoter that drives expression in a plant operably linked to at least a portion of a nucleotide sequence that corresponds to the transcript of the endogenous gene. Typically, such a nucleotide sequence has substantial sequence identity to the sequence of the transcript of the endogenous gene, generally greater than about 65% sequence identity, about 85% sequence identity, or greater than about 95% sequence identity. See, U.S. Pat. Nos. 5,283,184 and 5,034,323; herein incorporated by reference.

The polynucleotide of interest can also be a phenotypic marker. A phenotypic marker is screenable or a selectable marker that includes visual markers and selectable markers whether it is a positive or negative selectable marker. Any phenotypic marker can be used. Specifically, a selectable or screenable marker comprises a DNA segment that allows one to identify, or select for or against a molecule or a cell that contains it, often under particular conditions. These markers can encode an activity, such as, but not limited to, production of RNA, peptide, or protein, or can provide a binding site for RNA, peptides, proteins, inorganic and organic compounds or compositions and the like.

Examples of selectable markers include, but are not limited to, DNA segments that comprise restriction enzyme sites; DNA segments that encode products which provide resistance against otherwise toxic compounds including antibiotics, such as, spectinomycin, ampicillin, kanamycin, tetracycline, Basta, neomycin phosphotransferase II (NEO) and hygromycin phosphotransferase (HPT)); DNA segments that encode products which are otherwise lacking in the recipient cell (e.g., tRNA genes, auxotrophic markers); DNA segments that encode products which can be readily identified (e.g., phenotypic markers such as β-galactosidase, GUS; fluorescent proteins such as green fluorescent protein (GFP), cyan (CFP), yellow (YFP), red (RFP), and cell surface proteins); the generation of new primer sites for PCR (e.g., the juxtaposition of two DNA sequence not previously juxtaposed), the inclusion of DNA sequences not acted upon or acted upon by a restriction endonuclease or other DNA modifying enzyme, chemical, etc.; and, the inclusion of a DNA sequences required for a specific modification (e.g., methylation) that allows its identification.

Additional selectable markers include genes that confer resistance to herbicidal compounds, such as glufosinate ammonium, bromoxynil, imidazolinones, and 2,4-dichlorophenoxyacetate (2,4-D).

A site-specific recombination system can be employed in a variety of ways to manipulate the transgenic SSI target site that has been integrated at the DSB transgenic SSI target site. The site-specific recombination system employs various components which are described in detail below and in U.S. Pat. Nos. 6,187,994, 6,262,341, 6,331,661 and 6,300,545, each of which is herein incorporated by reference.

Various recombination sites can be employed in the methods and compositions provided herein (i.e. in the various transgenic SSI target sites or transfer cassettes disclosed herein). By "recombination site" is intended a naturally occurring recombination site and active variants thereof. Many recombination systems are known in the art and one of skill will recognize the appropriate recombination site to be used with the recombination system of interest. As discussed herein, various combinations of recombination sites can be employed including, sets of dissimilar sites and corresponding recombination sites and/or dissimilar and non-recombinogenic sites can be used in the various methods provided herein. Accordingly, any suitable recombination site or set of recombination sites may be utilized herein, including a FRT site, a biologically active variant of a FRT site (i.e. a mutant FRT site), a LOX site, a biologically active variant of a LOX site (i.e. a mutant LOX site), any combination thereof, or any other combination of recombination sites known in the art. Examples of FRT sites include but are not limited to, for example, the wild type FRT site (FRT1, SEQ ID NO: 576), and various mutant FRT sites, including but not limited to, FRT5 (SEQ ID NO: 577), FRT6 (SEQ ID NO: 578), FRT12 (SEQ ID NO: 579) and FRT87 (SEQ ID NO: 580). See, for example, U.S. Pat. No. 6,187,994 as well as FRT62 described in U.S. Pat. No. 8,318,493.

Recombination sites from the Cre/Lox site-specific recombination system can also be used. Such recombination sites include, for example, wild type LOX sites and mutant LOX sites. An analysis of the recombination activity of mutant LOX sites is presented in Lee et al. (1998) *Gene* 216:55-65, herein incorporated by reference. Also, see for example, Schlake and Bode (1994) *Biochemistry* 33:12746-12751; Huang et al. (1991) *Nucleic Acids Research* 19:443-448; Sadowski (1995) *In Progress in Nucleic Acid Research and Molecular Biology* Vol. 51, pp. 53-91; Cox (1989) In *Mobile DNA*, Berg and Howe (eds) American Society of Microbiology, Washington D.C., pp. 116-670; Dixon et al. (1995) *Mol. Microbiol.* 18:449-458; Umlauf and Cox (1988) *EMBO* 7:1845-1852; Buchholz et al. (1996) *Nucleic Acids Research* 24:3118-3119; Kilby et al. (1993) *Trends Genet.* 9:413-421; Rossant and Geagy (1995) *Nat. Med.* 1: 592-594; Albert et al. (1995) *The Plant J.* 7:649-659; Bayley et al. (1992) *Plant Mol. Biol.* 18:353-361; Odell et al. (1990) *Mol. Gen. Genet.* 223:369-378; Dale and Ow (1991) *Proc. Natl. Acad. Sci. USA* 88:10558-10562; Qui et al. (1994) *Proc. Natl. Acad. Sci. USA* 91:1706-1710; Stuurman et al. (1996) *Plant Mol. Biol.* 32:901-913; Dale et al. (1990) *Gene* 91:79-85; Albert et al. (1995) *The Plant J.* 7:649-659 and WO 01/00158; all of which are herein incorporated by reference.

Active variants and fragments of recombination sites (i.e. SEQ ID NOS: 576-580) are also encompassed by the compositions and methods provided herein. Fragments of a recombination site retain the biological activity of the recombination site and hence facilitate a recombination event in the presence of the appropriate recombinase. Thus, fragments of a recombination site may range from at least about 5, 10, 15, 20, 25, 30, 35, 40 nucleotides, and up to the full-length of a recombination site. Active variants can comprise at least 65%, 70%, 75%, 80%, 85%, 90%, 91%, 92%, 93%, 94%, 95%, 96%, 97%, 98%, 99% or more sequence identity to the native recombination site, wherein the active variants retain biological activity and hence facilitate a recombination event in the presence of the appropriate recombinase. Assays to measure the biological activity of recombination sites are known in the art. See, for example, Senecoll et al. (1988) *J. Mol. Biol.* 201:406-421; Voziyanov et al. (2002) *Nucleic Acid Research* 30:7, U.S. Pat. No. 6,187,994, WO/01/00158, and Albert et al. (1995) *The Plant Journal* 7:649-659.

Recombinases are also employed in the methods and compositions provided herein. By "recombinase" is intended a native polypeptide that catalyzes site-specific recombination between compatible recombination sites. For reviews of site-specific recombinases, see Sauer (1994) *Current Opinion in Biotechnology* 5:521-527; and Sadowski (1993) *FASEB* 7:760-767; the contents of which are incorporated herein by reference. The recombinase used in the methods can be a naturally occurring recombinase or a biologically active fragment or variant of the recombinase. Recombinases useful in the methods and compositions include recombinases from the Integrase and Resolvase families, biologically active variants and fragments thereof, and any other naturally occurring or recombinantly produced enzyme or variant thereof that catalyzes conservative site-specific recombination between specified DNA recombination sites.

The Integrase family of recombinases has over one hundred members and includes, for example, FLP, Cre, Int, and R. For other members of the Integrase family, see for example, Esposito et al. (1997) *Nucleic Acid Research* 25:3605-3614 and Abremski et al. (1992) *Protein Engineering* 5:87-91, both of which are herein incorporated by reference. Other recombination systems include, for example, the streptomycete bacteriophage phi C31 (Kuhstoss et al. (1991) *J. Mol. Biol.* 20:897-908); the SSV1 site-specific recombination system from *Sulfolobus shibatae* (Maskhelishvili et al. (1993) *Mol. Gen. Genet.* 237:334-342); and a retroviral integrase-based integration system (Tanaka et al. (1998) *Gene* 17:67-76). In other embodiments, the recombinase is one that does not require cofactors or a supercoiled substrate. Such recombinases include Cre, FLP, or active variants or fragments thereof.

The FLP recombinase is a protein that catalyzes a site-specific reaction that is involved in amplifying the copy number of the two-micron plasmid of *S. cerevisiae* during DNA replication. As used herein, FLP recombinase refers to a recombinase that catalyzes site-specific recombination between two FRT sites. The FLP protein has been cloned and expressed. See, for example, Cox (1993) *Proc. Natl. Acad. Schi. U.S.A.* 80:4223-4227. The FLP recombinase for use in the methods and with the compositions may be derived from the genus *Saccharomyces*. One can also synthesize a polynucleotide comprising the recombinase using plant-preferred codons for optimal expression in a plant of interest. A recombinant FLP enzyme encoded by a nucleotide sequence comprising maize preferred codons (FLPm) that catalyzes site-specific recombination events is known. See, for example, U.S. Pat. No. 5,929,301, herein incorporated by reference. Additional functional variants and fragments of FLP are known. See, for example, Buchholz et al. (1998) *Nat. Biotechnol.* 16:617-618, Hartung et al. (1998) *J. Biol. Chem.* 273:22884-22891, Saxena et al. (1997) *Biochim Biophys Acta* 1340(2):187-204, and Hartley et al. (1980) *Nature* 286:860-864, all of which are herein incorporated by reference.

The bacteriophage recombinase Cre catalyzes site-specific recombination between two lox sites. The Cre recombinase is known in the art. See, for example, Guo et al. (1997) *Nature* 389:40-46; Abremski et al. (1984) *J. Biol. Chem.* 259:1509-1514; Chen et al. (1996) *Somat. Cell Mol. Genet.* 22:477-488; Shaikh et al. (1977) *J. Biol. Chem.* 272:5695-5702; and, Buchholz et al. (1998) *Nat. Biotechnol.* 16:617-618, all of which are herein incorporated by reference. The Cre polynucleotide sequences may also be synthesized using plant-preferred codons. Such sequences (mo-Cre) are described in WO 99/25840, herein incorporated by reference.

It is further recognized that a chimeric recombinase can be used in the methods. By "chimeric recombinase" is intended a recombinant fusion protein which is capable of catalyzing site-specific recombination between recombination sites that originate from different recombination systems. That is, if a set of functional recombination sites, characterized as being dissimilar and non-recombinogenic with respect to one another, is utilized in the methods and compositions and comprises a FRT site and a LoxP site, a chimeric FLP/Cre recombinase or active variant or fragment thereof will be needed or, alternatively, both recombinases may be separately provided. Methods for the production and use of such chimeric recombinases or active variants or fragments thereof are described in WO 99/25840, herein incorporated by reference.

By utilizing various combinations of recombination sites in the transgenic SSI target sites and the transfer cassettes provided herein, the methods provide a mechanism for the site-specific integration of polynucleotides of interest into a specific site in the plant genome. The methods also allow for the subsequent insertion of additional polynucleotides of interest into the specific genomic site.

In one embodiment, providing the recombinase comprises integrating into the genome of the plant cell a nucleotide sequence encoding the recombinase. In a specific embodiment, the recombinase is FLP. In yet another embodiment, the FLP recombinase is synthesized using maize-preferred codons or soybean-preferred codons.

As used herein, "providing" can include any method that allows for an amino acid sequence and/or a polynucleotide to be brought together with the recited components. A variety of methods are known in the art for the introduction of nucleotide sequence into a plant. Any means can be used to bring together the various components of the recombination system (i.e., the transgenic SSI target site, transfer cassette, and the appropriate recombinase), including, for example, transformation and sexual crossing. See, also, WO99/25884 herein incorporated by reference. In addition, as discussed elsewhere herein, the recombinase may also be provided by the introduction of the polypeptide or mRNA into the cell.

Active variants and fragments of recombinases (i.e. FLP or Cre) are also encompassed by the compositions and methods provided herein. Such active variants can comprise at least 65%, 70%, 75%, 80%, 85%, 90%, 91%, 92%, 93%, 94%, 95%, 96%, 97%, 98%, 99% or more sequence identity to the native recombinase, wherein the active variants retain biological activity and hence implement a recombination event. Assays for recombinase activity are known and generally measure the overall activity of the enzyme on DNA substrates containing recombination sites.

As discussed above, various methods can be used to insert polynucleotides of interest into the transgenic SSI target site in a plant or plant cell. Non-limiting examples of various DNA constructs, transgenic SSI target sites, and transfer cassettes that can be used to insert a polynucleotide of interest into a plant or plant cell are described in PCT/US12/47202 application filed Jul. 18, 2012, incorporated by reference in its entirety herein. In short, once the transgenic SSI target site has integrated into the DSB target site or once the transfer cassette has integrated into the transgenic SSI target site, the appropriate selective agent can be employed to identify the plant cell having the desired DNA construct. Once a transgenic SSI target site has been established within the genome, additional recombination sites may be introduced by incorporating such sites within the nucleotide sequence of the transfer cassette. Thus, once a transgenic SSI target site has been established, it is possible to subsequently add or alter sites through recombination. Such methods are described in detail in WO 99/25821, herein incorporated by reference.

In one embodiment, multiple genes or polynucleotides of interest can be stacked at the transgenic SSI target site in the genome of the plant. For example, as illustrated in Table 1, scheme D, the transgenic SSI target site integrated at the DSB target site can comprise the following components: RSF1::P1::R1::S1::T1-P2::NT1::T2-P3::R2-R3::RSF2, where RSF is a fragment of the DSB target site, P is a promoter active in a plant, R is a recombination site, S is the selection marker, T is a termination region, and NT is a polynucleotide of interest. The following transfer cassette comprising the following components could be introduced: R2::S2::T3-P4::NT2::T4-R3 (RSF=DSB target site fragment; P=promoter active in a plant; R=recombination site; S=selection marker; T=terminator region; NT=polynucleotide of interest; the symbol :: implies a fusion between adjacent elements and implies that the sequences are put together to generate an in frame fusion that results in a properly expressed and functional gene product). The plant with this transfer cassette integrated at the transgenic SSI target site, can then be selected for based on the second selection marker. In this manner, multiple sequences can be stacked at predetermined locations in the transgenic SSI target site. Various alterations can be made to the stacking method described above and still achieve the desired outcome of having the polynucleotides of interest stacked in the genome of the plant.

Methods and compositions are provided herein that combine a DSB-inducing-agent system, such as for example a guide polynucleotide/Cas endonuclease system (as described in U.S. patent application Ser. No. 14/463,687 filed on Aug. 20, 2014, incorporated by reference in its entirety herein, and U.S. patent application Ser. No. 14/463,691 filed on Aug. 20, 2014, incorporated by reference in its entirety herein) with a site-specific recombinase system which allow, for example, for improved methods and compositions for the targeted insertion of a sequence of interest in the genome of a plant. The methods provided herein comprise introducing into the genome of a plant cell a transgenic SSI target site into a DSB target site, wherein the transgenic SSI target site can optionally comprise a polynucleotide of interest.

By "introducing" is intended presenting to the plant the transgenic SSI target site in such a manner that the sequence gains access to the interior of a cell of the plant. Methods for introducing sequences into plants are known in the art and include, but are not limited to, stable transformation methods, transient transformation methods, virus-mediated methods, and sexual breeding. Thus, "introduced" in the context of inserting a nucleic acid fragment (e.g., various components of the site-specific integration system provided herein) into a cell, means "transfection" or "transformation" or "transduction" and includes reference to the incorporation of a nucleic acid fragment into a eukaryotic or prokaryotic cell where the nucleic acid fragment may be incorporated into the genome of the cell (e.g., chromosome, plasmid, plastid, or mitochondrial DNA), converted into an autonomous replicon, or transiently expressed (e.g., transfected mRNA).

In some embodiments, the plant cells, plants and seeds employed in the methods and compositions have a DNA construct stably incorporated into their genome. By "stably incorporated" or "stably introduced" is intended the introduction of a polynucleotide into the plant such that the nucleotide sequence integrates into the genome of the plant and is capable of being inherited by progeny thereof. Any protocol may be used for the stable incorporation of the DNA constructs or the various components of the site-specific integration system employed herein.

Transformation protocols as well as protocols for introducing polypeptides or polynucleotide sequences into plants may vary depending on the type of plant or plant cell, i.e., monocot or dicot, targeted for transformation. Suitable methods of introducing polypeptides and polynucleotides into plant cells include microinjection (Crossway et al. (1986) *Biotechniques* 4:320-334), electroporation (Riggs et al. (1986) *Proc. Natl. Acad. Sci. USA* 83:5602-5606, *Agrobacterium*-mediated transformation (U.S. Pat. Nos. 5,563,055 and 5,981,840), direct gene transfer (Paszkowski et al. (1984) *EMBO J.* 3:2717-2722), and ballistic particle acceleration (see, for example, U.S. Pat. Nos. 4,945,050; 5,879,918; 5,886,244; and, 5,932,782; Tomes et al. (1995) in *Plant Cell, Tissue, and Organ Culture: Fundamental Methods*, ed. Gamborg and Phillips (Springer-Verlag, Berlin); McCabe et al. (1988) *Biotechnology* 6:923-926); and Lec1 transformation (WO 00/28058). Also see Weissinger et al. (1988) *Ann. Rev. Genet.* 22:421-477; Sanford et al. (1987) *Particulate Science and Technology* 5:27-37 (onion); Christou et al. (1988) *Plant Physiol.* 87:671-674 (soybean); McCabe et al. (1988) *Bio/Technology* 6:923-926 (soybean); Finer and McMullen (1991) *In Vitro Cell Dev. Biol.* 27P:175-182 (soybean); Singh et al. (1998) *Theor. Appl. Genet.* 96:319-324 (soybean); Datta et al. (1990) *Biotechnology* 8:736-740 (rice); Klein et al. (1988) *Proc. Natl. Acad. Sci. USA* 85:4305-4309 (maize); Klein et al. (1988) *Biotechnology* 6:559-563 (maize); U.S. Pat. Nos. 5,240,855; 5,322,783; and, 5,324,646; Klein et al. (1988) *Plant Physiol.* 91:440-444 (maize); Fromm et al. (1990) *Biotechnology* 8:833-839 (maize); Hooykaas-Van Slogteren et al. (1984) *Nature* (London) 311:763-764; U.S. Pat. No. 5,736,369 (cereals); Bytebier et al. (1987) *Proc. Natl. Acad. Sci. USA* 84:5345-5349 (Liliaceae); De Wet et al. (1985) in *The Experimental Manipulation of Ovule Tissues*, ed. Chapman et al. (Longman, New York), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation); Li et al. (1993) *Plant Cell Reports* 12:250-255 and Christou and Ford (1995) *Annals of Botany* 75:407-413 (rice); Osjoda et al. (1996) *Nature Biotechnology* 14:745-750 (maize via *Agrobacterium tumefaciens*); all of which are herein incorporated by reference.

In other embodiments, any of the polynucleotides employed herein may be introduced into plants by contacting plants with a virus or viral nucleic acids. Generally, such methods involve incorporating a desired polynucleotide within a viral DNA or RNA molecule. It is recognized that a sequence employed in the methods or compositions provided herein may be initially synthesized as part of a viral polyprotein, which later may be processed by proteolysis in vivo or in vitro to produce the desired recombinant protein. Further, it is recognized that promoters employed herein also encompass promoters utilized for transcription by viral RNA polymerases. Methods for introducing polynucleotides into plants and expressing a protein encoded therein, involving viral DNA or RNA molecules, are known in the art. See, for example, U.S. Pat. Nos. 5,889,191, 5,889,190, 5,866,785, 5,589,367, 5,316,931, and Porta et al. (1996) *Molecular Biotechnology* 5:209-221; herein incorporated by reference.

In other embodiments, various components of the site-specific integration system can be provided to a plant using a variety of transient transformation methods. "Transient transformation" is intended to mean that a polynucleotide is introduced into the host (i.e., a plant) and expressed temporally. Such transient transformation methods include, but are not limited to, the introduction of any of the components of the site-specific integration system or active fragments or variants thereof directly into the plant or the introduction of the transcript into the plant. Such methods include, for example, microinjection or particle bombardment. See, for example, Crossway et al. (1986) *Mol Gen. Genet.* 202:179-185; Nomura et al. (1986) *Plant Sci.* 44:53-58; Hepler et al. (1994) *Proc. Natl. Acad. Sci.* 91: 2176-2180 and Hush et al. (1994) *The Journal of Cell Science* 107:775-784, all of which are herein incorporated by reference. Alternatively, the polynucleotide can be transiently transformed into the plant using techniques known in the art. Such techniques include viral vector system and the precipitation of the polynucleotide in a manner that precludes subsequent release of the DNA. Thus, the transcription from the particle-bound DNA can occur, but the frequency with which it is released to become integrated into the genome is greatly reduced. Such methods include the use particles coated with polyethylimine (PEI; Sigma #P3143).

The cells that have been transformed may be grown into plants in accordance with conventional ways. See, for example, McCormick et al. (1986) *Plant Cell Reports* 5:81-84. These plants may then be grown, and either pollinated with the same transformed strain or different strains, and the resulting progeny having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, transformed seed having the recited DNA construct stably incorporated into their genome is provided.

In one embodiment, the plant cell, a plant, a plant part and a seed having a transgenic SSI target site integrated at a DSB target site comprises a transgenic SSI target site comprising in the following order, a first recombination site, a second recombination site and wherein the first and the second recombination sites are dissimilar and non-recombinogenic with respect to one another. The transgenic SSI target site can further comprise a polynucleotide of interest between the first and the second recombination sites. The recombination sites can be any combination of recombination sites known in the art. For example, the recombination sites can be a FRT site, a mutant FRT site, a LOX site or a mutant LOX site.

In specific embodiments, the transgenic SSI target site of the plant cell, plant, plant part and seed further comprises a third recombination site between the first and the second recombination site, wherein the third recombination site is dissimilar and non-recombinogenic to the first and the second recombination sites. The first, second, and third recombination sites can comprise, for example, FRT1, FRT5, FRT6, FRT12, FRT62 (described in US patent U.S. Pat. No. 8,318,493 issued on Nov. 27, 2012, herein incorporated by reference), or FRT87. Also, provided is a plant cell, plant, or seed wherein the first recombination site is FRT1, the second recombination site is FRT12 and the third recombination site is FRT87.

As used herein, the term plant includes plant cells, plant protoplasts, plant cell tissue cultures from which a plant can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included herein, provided that these parts comprise the recited DNA construct.

A transgenic plant includes, for example, a plant which comprises within its genome a heterologous polynucleotide introduced by a transformation step. The heterologous polynucleotide can be stably integrated within the genome such that the polynucleotide is passed on to successive generations. The heterologous polynucleotide may be integrated into the genome alone or as part of a recombinant DNA construct. A transgenic plant can also comprise more than one heterologous polynucleotide within its genome. Each heterologous polynucleotide may confer a different trait to the transgenic plant. A heterologous polynucleotide can include a sequence that originates from a foreign species, or, if from the same species, can be substantially modified from its native form. Transgenic can include any cell, cell line, callus, tissue, plant part or plant, the genotype of which has been altered by the presence of heterologous nucleic acid including those transgenics initially so altered as well as those created by sexual crosses or asexual propagation from the initial transgenic. The alterations of the genome (chromosomal or extra-chromosomal) by conventional plant breeding methods, by the genome editing procedure described herein that does not result in an insertion of a foreign polynucleotide, or by naturally occurring events such as random cross-fertilization, non-recombinant viral infection, non-recombinant bacterial transformation, non-recombinant transposition, or spontaneous mutation are not intended to be regarded as transgenic.

In certain embodiments of the disclosure, a fertile plant is a plant that produces viable male and female gametes and is self-fertile. Such a self-fertile plant can produce a progeny plant without the contribution from any other plant of a gamete and the genetic material contained therein. Other embodiments of the disclosure can involve the use of a plant that is not self-fertile because the plant does not produce male gametes, or female gametes, or both, that are viable or otherwise capable of fertilization. As used herein, a "male sterile plant" is a plant that does not produce male gametes that are viable or otherwise capable of fertilization. As used herein, a "female sterile plant" is a plant that does not produce female gametes that are viable or otherwise capable of fertilization. It is recognized that male-sterile and female-sterile plants can be female-fertile and male-fertile, respectively. It is further recognized that a male fertile (but female sterile) plant can produce viable progeny when crossed with a female fertile plant and that a female fertile (but male sterile) plant can produce viable progeny when crossed with a male fertile plant.

The components of the site-specific integration system provided herein may be used for transformation of any plant species, including, but not limited to, monocots and dicots. Examples of plant species of interest include, but are not limited to, corn (maize) (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (Carthamus tinctorius), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (Musa spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum.

Conifers that may be employed include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). In specific embodiments, plants are crop plants (for example, corn, alfalfa, sunflower, *Brassica*, soybean, cotton, safflower, peanut, sorghum, wheat, millet, tobacco, etc.). In other embodiments, corn and soybean plants are optimal, and in yet other embodiments corn plants are optimal.

Other plants of interest include grain plants that provide seeds of interest, oil-seed plants, and leguminous plants. Seeds of interest include grain seeds, such as corn, wheat, barley, rice, sorghum, rye, etc. Oil-seed plants include cotton, soybean, safflower, sunflower, *Brassica*, maize, alfalfa, palm, coconut, etc. Leguminous plants include beans and peas. Beans include guar, locust bean, fenugreek, soybean, garden beans, cowpea, mungbean, lima bean, fava bean, lentils, chickpea, etc.

It is recognized that the plant having stably incorporated the DNA construct can be further characterized for site-specific integration potential, agronomic potential, and copy number. See, U.S. Pat. No. 6,187,994.

Depending on the polynucleotide(s) of interest incorporated into the transgenic SSI target site, the transgenic plants, plant cells, or seeds comprising a transgenic SSI target site with a polynucleotide(s) of interest provided herein may have a change in phenotype, including, but not limited to, an altered pathogen or insect defense mechanism, an increased resistance to one or more herbicides, an increased ability to withstand stressful environmental conditions, a modified ability to produce starch, a modified level of starch production, a modified oil content and/or composition, a modified carbohydrate content and/or composition, a modified fatty acid content and/or composition, a modified ability to utilize, partition and/or store nitrogen, and the like.

Provided herein are polynucleotides or nucleic acid molecules comprising the various components of the DSB-inducing-agent system, such as for example a guide polynucleotide/Cas endonuclease system (as described in U.S. patent application Ser. No. 14/463,687 filed on Aug. 20, 2014 and U.S. patent application Ser. No. 14/463,691 filed on Aug. 20, 2014) and the site-specific integration system (transgenic SSI target site, a donor DNA, a transfer cassette, various site-specific recombination sites, site-specific recombinases, polynucleotides of interest or any active variants or fragments thereof). Also provided are nucleic acid molecules comprising any of the various transgenic SSI target sites provided herein integrated at the DSB target site in the plant genome.

The terms "polynucleotide," "polynucleotide sequence," "nucleic acid sequence," and "nucleic acid fragment" are used interchangeably herein. These terms encompass nucleotide sequences and the like. A polynucleotide may be a polymer of RNA or DNA that is single- or double-stranded, that optionally contains synthetic, non-natural or altered nucleotide bases. A polynucleotide in the form of a polymer of DNA may be comprised of one or more segments of cDNA, genomic DNA, synthetic DNA, or mixtures thereof. The use of the term "polynucleotide" is not intended to limit the present invention to polynucleotides comprising DNA. Those of ordinary skill in the art will recognize that polynucleotides, can comprise ribonucleotides and combinations of ribonucleotides and deoxyribonucleotides. Such deoxyribonucleotides and ribonucleotides include both naturally occurring molecules and synthetic analogues. The polynucleotides provided herein also encompass all forms of sequences including, but not limited to, single-stranded forms, double-stranded forms, hairpins, stem-and-loop structures, and the like.

The compositions provided herein can comprise an isolated or substantially purified polynucleotide. An "isolated" or "purified" polynucleotide is substantially or essentially free from components that normally accompany or interact with the polynucleotide as found in its naturally occurring environment. Thus, an isolated or purified polynucleotide is substantially free of other cellular material, or culture medium when produced by recombinant techniques, or substantially free of chemical precursors or other chemicals when chemically synthesized. Optimally, an "isolated" polynucleotide is free of sequences (optimally protein encoding sequences) that naturally flank the polynucleotide (i.e., sequences located at the 5' and 3' ends of the polynucleotide) in the genomic DNA of the organism from which the polynucleotide is derived. For example, in various embodiments, the isolated polynucleotide can contain less than about 5 kb, 4 kb, 3 kb, 2 kb, 1 kb, 0.5 kb, or 0.1 kb of nucleotide sequence that naturally flank the polynucleotide in genomic DNA of the cell from which the polynucleotide is derived.

The terms "recombinant polynucleotide" and "recombinant DNA construct" are used interchangeably herein. A recombinant construct can comprise an artificial or heterologous combination of nucleic acid sequences, e.g., regulatory and coding sequences that are not found together in nature. For example, a transfer cassette can comprise restriction sites and a heterologous polynucleotide of interest. In other embodiments, a recombinant construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments provided herein. The skilled artisan will also recognize that different independent transformation events will result in different levels and patterns of expression (Jones et al., *EMBO J.* 4:2411-2418 (1985); De Almeida et al., *Mol. Gen. Genetics* 218:78-86 (1989)), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others.

In specific embodiments, one or more of the components of the site-specific integration system described herein can be provided in an expression cassette for expression in a plant or other organism or cell type of interest. The cassette can include 5' and 3' regulatory sequences operably linked to a polynucleotide provided herein. "Operably linked" is intended to mean a functional linkage between two or more elements. For example, an operable linkage between a polynucleotide of interest and a regulatory sequence (i.e., a promoter) is a functional link that allows for expression of the polynucleotide of interest. Operably linked elements may be contiguous or non-contiguous. When used to refer to the joining of two protein coding regions, by operably linked is intended that the coding regions are in the same reading frame. The cassette may additionally contain at least one additional gene to be cotransformed into the organism. Alternatively, the additional gene(s) can be provided on multiple expression cassettes. Such an expression cassette is provided with a plurality of restriction sites and/or recombination sites for insertion of a recombinant polynucleotide to be under the transcriptional regulation of the regulatory regions. The expression cassette may additionally contain selectable marker genes.

The expression cassette can include in the 5'-3' direction of transcription, a transcriptional and translational initiation region (i.e., a promoter), a recombinant polynucleotide provided herein, and a transcriptional and translational termination region (i.e., termination region) functional in plants. The regulatory regions (i.e., promoters, transcriptional regulatory regions, and translational termination regions) and/or a polynucleotide provided herein may be native/analogous to the host cell or to each other. Alternatively, the regulatory regions and/or a polynucleotide provided herein may be heterologous to the host cell or to each other. As used herein, "heterologous" in reference to a sequence is a sequence that originates from a foreign species, or, if from the same species, is substantially modified from its native form in composition and/or genomic locus by deliberate human intervention. For example, a promoter operably linked to a heterologous polynucleotide is from a species different from the species from which the polynucleotide was derived, or, if from the same/analogous species, one or both are substantially modified from their original form and/or genomic locus, or the promoter is not the native promoter for the operably linked polynucleotide. Alternatively, the regulatory regions and/or a recombinant polynucleotide provided herein may be entirely synthetic.

The termination region may be native with the transcriptional initiation region, may be native with the operably linked recombinant polynucleotide, may be native with the plant host, or may be derived from another source (i.e., foreign or heterologous) to the promoter, the recombinant polynucleotide, the plant host, or any combination thereof. Convenient termination regions are available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acids Res.* 15:9627-9639.

In preparing the expression cassette, the various DNA fragments may be manipulated, so as to provide for the DNA sequences in the proper orientation. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used in the expression cassettes provided herein. The promoters can be selected based on the desired outcome. It is recognized that different applications can be enhanced by the use of different promoters in the expression cassettes to modulate the timing, location and/or level of expression of the polynucleotide of interest. Such expression constructs may also contain, if desired, a promoter regulatory region (e.g., one conferring inducible, constitutive, environmentally- or developmentally-regulated, or cell- or tissue-specific/selective expression), a transcription initiation start site, a ribosome binding site, an RNA processing signal, a transcription termination site, and/or a polyadenylation signal.

In some embodiments, an expression cassette provided herein can be combined with constitutive, tissue-preferred, or other promoters for expression in plants. Examples of constitutive promoters include the cauliflower mosaic virus (CaMV) 35S transcription initiation region, the 1'- or 2'-promoter derived from T-DNA of *Agrobacterium tumefaciens*, the ubiquitin 1 promoter, the Smas promoter, the cinnamyl alcohol dehydrogenase promoter (U.S. Pat. No. 5,683,439), the Nos promoter, the pEmu promoter, the rubisco promoter, the GRP1-8 promoter and other transcription initiation regions from various plant genes known to those of skill. If low level expression is desired, weak promoter(s) may be used. Weak constitutive promoters include, for example, the core promoter of the Rsyn7 promoter (WO 99/43838 and U.S. Pat. No. 6,072,050), the core 35S CaMV promoter, and the like. Other constitutive promoters include, for example, U.S. Pat. Nos. 5,608,149; 5,608,144; 5,604,121; 5,569,597; 5,466,785; 5,399,680; 5,268,463; and 5,608,142. See also, U.S. Pat. No. 6,177,611, herein incorporated by reference.

Examples of inducible promoters are the Adh1 promoter which is inducible by hypoxia or cold stress, the Hsp70 promoter which is inducible by heat stress, the PPDK promoter and the pepcarboxylase promoter which are both inducible by light. Also useful are promoters which are chemically inducible, such as the In2-2 promoter which is safener induced (U.S. Pat. No. 5,364,780), the ERE promoter which is estrogen induced, and the Axig1 promoter which is auxin induced and tapetum specific but also active in callus (PCT US01/22169).

Examples of promoters under developmental control include promoters that initiate transcription preferentially in certain tissues, such as leaves, roots, fruit, seeds, or flowers. An exemplary promoter is the anther specific promoter 5126 (U.S. Pat. Nos. 5,689,049 and 5,689,051). Examples of seed-preferred promoters include, but are not limited to, 27 kD gamma zein promoter and waxy promoter, Boronat, A. et al. (1986) *Plant Sci.* 47:95-102; Reina, M. et al. *Nucl. Acids Res.* 18(21):6426; and Kloesgen, R. B. et al. (1986) *Mol. Gen. Genet.* 203:237-244. Promoters that express in the embryo, pericarp, and endosperm are disclosed in U.S. Pat. No. 6,225,529 and PCT publication WO 00/12733. The disclosures for each of these are incorporated herein by reference in their entirety.

Chemical-regulated promoters can be used to modulate the expression of a gene in a plant through the application of an exogenous chemical regulator. Depending upon the objective, the promoter may be a chemical-inducible promoter, where application of the chemical induces gene expression, or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena et al. (1991) *Proc. Natl. Acad. Sci. USA* 88:10421-10425 and McNellis et al. (1998) *Plant J.* 14(2):247-257) and tetracycline-inducible and tetracycline-repressible promoters (see, for example, Gatz et al. (1991) *Mol. Gen. Genet.* 227:229-237, and U.S. Pat. Nos. 5,814,618 and 5,789,156), herein incorporated by reference.

Tissue-preferred promoters can be utilized to target enhanced expression of a polynucleotide of interest within a particular plant tissue. Tissue-preferred promoters are known in the art. See, for example, Yamamoto et al. (1997) *Plant J.* 12(2):255-265; Kawamata et al. (1997) *Plant Cell Physiol.* 38(7):792-803; Hansen et al. (1997) *Mol. Gen Genet.* 254(3):337-343; Russell et al. (1997) *Transgenic Res.* 6(2):157-168; Rinehart et al. (1996) *Plant Physiol.* 112(3):1331-1341; Van Camp et al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco et al. (1993) *Plant Mol Biol.* 23(6): 1129-1138; Matsuoka et al. (1993) *Proc Natl. Acad. Sci. USA* 90(20):9586-9590; and Guevara-Garcia et al. (1993) *Plant J.* 4(3):495-505. Such promoters can be modified, if necessary, for weak expression.

Leaf-preferred promoters are known in the art. See, for example, Yamamoto et al. (1997) *Plant J.* 12(2):255-265; Kwon et al. (1994) *Plant Physiol.* 105:357-67; Yamamoto et al. (1994) *Plant Cell Physiol.* 35(5):773-778; Gotor et al. (1993) *Plant J.* 3:509-18; Orozco et al. (1993) *Plant Mol. Biol.* 23(6):1129-1138; and Matsuoka et al. (1993) *Proc. Natl. Acad. Sci. USA* 90(20):9586-9590. In addition, the promoters of cab and rubisco can also be used. See, for example, Simpson et al. (1958) *EMBO J* 4:2723-2729 and Timko et al. (1988) *Nature* 318:57-58.

Root-preferred promoters are known and can be selected from the many available from the literature or isolated de novo from various compatible species. See, for example, Hire et al. (1992) *Plant Mol. Biol.* 20(2):207-218 (soybean root-specific glutamine synthetase gene); Keller and Baumgartner (1991) *Plant Cell* 3(10):1051-1061 (root-specific control element in the GRP 1.8 gene of French bean); Sanger et al. (1990) *Plant Mol. Biol.* 14(3):433-443 (root-specific promoter of the mannopine synthase (MAS) gene of *Agrobacterium tumefaciens*); and Miao et al. (1991) *Plant Cell* 3(1):11-22 (full-length cDNA clone encoding cytosolic glutamine synthetase (GS), which is expressed in roots and root nodules of soybean). See also Bogusz et al. (1990) *Plant Cell* 2(7):633-641, where two root-specific promoters isolated from hemoglobin genes from the nitrogen-fixing non-legume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus comiculatus*, and in both instances root-specific promoter activity was preserved. Leach and Aoyagi (1991) describe their analysis of the promoters of the highly expressed roIC and roID root-inducing genes of *Agrobacterium rhizogenes* (see Plant Science (Limerick) 79(1):69-76). They concluded that enhancer and tissue-preferred DNA determinants are dissociated in those promoters. Teeri et al. (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see *EMBO J.* 8(2): 343-350). The TR1' gene, fused to nptII (neomycin phosphotransferase II) showed similar characteristics. Additional root-preferred promoters include the VfENOD-GRP3 gene promoter (Kuster et al. (1995) *Plant Mol. Biol.* 29(4):759-772); and roIB promoter (Capana et al. (1994) *Plant Mol. Biol.* 25(4):681-691. See also U.S. Pat. Nos. 5,837,876; 5,750,386; 5,633,363; 5,459,252; 5,401,836; 5,110,732; and 5,023,179. The phaseolin gene (Murai et al. (1983) *Science* 23:476-482 and Sengopta-Gopalen et al. (1988) *PNAS* 82:3320-3324.

The expression cassette containing the polynucleotides provided herein can also comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D) and sulfonylureas. Additional selectable markers include phenotypic markers such as beta-galactosidase and fluorescent proteins such as green fluorescent protein (GFP) (Su et al. (2004) *Biotechnol. Bioeng.* 85:610-9 and Fetter et al. (2004) *Plant Cell* 16:215-28), cyan fluorescent protein (CYP) (Bolte et al. (2004) *J. Cell Science* 117:943-54 and Kato et al. (2002) *Plant Physiol.* 129:913-42), and yellow fluorescent protein (PhiYFP™ from Evrogen; see, Bolte et al. (2004) *J. Cell Science* 117:943-54). Such disclosures are herein incorporated by reference. The above list of selectable marker genes is not meant to be limiting. Any selectable marker gene can be used in the compositions presented herein.

Where appropriate, the sequences employed in the methods and compositions (i.e., the polynucleotide of interest, the recombinase, the endonuclease, etc.) may be optimized for increased expression in the transformed plant. That is, the genes can be synthesized using plant-preferred codons for improved expression. See, for example, Campbell and Gowri (1990) *Plant Physiol.* 92:1-11 for a discussion of host-preferred codon usage. Methods are available in the art for synthesizing plant-preferred genes. See, for example, U.S. Pat. Nos. 5,380,831, and 5,436,391, and Murray et al. (1989) *Nucleic Acids Res.* 17:477-498, herein incorporated by reference.

Fragments and variants of the various components of the DSB-inducing-agent system, such as for example the guide polynucleotide/Cas endonuclease system and the site-specific integration system (transgenic SSI target site, a donor DNA, a transfer cassette, various site-specific recombination sites, site-specific recombinases, polynucleotides of interest or any active variants or fragments thereof) are also encompassed herein. By "fragment" is intended a portion of the polynucleotide or a portion of the amino acid sequence and hence protein encoded thereby. Fragments of a polynucleotide may encode protein fragments that retain the biological activity of the native protein (i.e., a fragment of a recombinase implements a recombination event). As used herein, a "native" polynucleotide or polypeptide comprises a naturally occurring nucleotide sequence or amino acid sequence, respectively. Thus, fragments of a polynucleotide may range from at least about 20 nucleotides, about 50 nucleotides, about 100 nucleotides, and up to the full-length polynucleotide. A fragment of a polynucleotide that encodes a biologically active portion of a protein employed in the methods or compositions will encode at least 15, 25, 30, 50, 100, 150, 200, or 250 contiguous amino acids, or up to the total number of amino acids present in a full-length protein. Alternatively, fragments of a polynucleotide that are useful as a hybridization probe generally do not encode fragment proteins retaining biological activity. Thus, fragments of a nucleotide sequence may range from at least about 10, 20, 30, 40, 50, 60, 70, 80 nucleotides or up to the full length sequence.

A biologically active portion of a polypeptide can be prepared by isolating a portion of one of the polynucleotides encoding the portion of the polypeptide of interest and expressing the encoded portion of the protein (e.g., by recombinant expression in vitro), and assessing the activity of the portion of the polypeptide. For example, polynucleotides that encode fragments of a recombinase polypeptide can comprise nucleotide sequence comprising at least 16, 20, 50, 75, 100, 150, 200, 250, 300, 350, 400, 450, 500, 550, 600, 650, 700, 800, 900, 1,000, 1,100, 1,200, 1,300, or 1,400 nucleotides, or up to the number of nucleotides present in a nucleotide sequence employed in the methods and compositions provided herein.

"Variants" is intended to mean substantially similar sequences. For polynucleotides, a variant comprises a polynucleotide having deletions (i.e., truncations) at the 5' and/or 3' end; deletion and/or addition of one or more nucleotides at one or more internal sites in the native polynucleotide; and/or substitution of one or more nucleotides at one or more sites in the native polynucleotide. For polynucleotides, conservative variants include those sequences that, because of the degeneracy of the genetic code, encode the amino acid sequence of one of the polypeptides employed in the compositions and methods provided herein. Naturally occurring allelic variants such as these, or naturally occurring allelic variants of polynucleotides can be identified with the use of well-known molecular biology techniques, as, for example, with polymerase chain reaction (PCR) and hybridization techniques as outlined below. Variant polynucleotides also include synthetically derived polynucleotides, such as those generated, for example, by using site-directed mutagenesis. Generally, variants of a particular polynucleotide employed in the methods and compositions provided herein will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular polynucleotide as determined by sequence alignment programs and parameters as described elsewhere herein.

Variants of a particular polynucleotide employed in the methods and compositions provided herein (i.e., Cas 9 endonucleases, DSB target sites, transgenic SSI target sites, recombinases, recombination sites, and polynucleotides of interest) can also be evaluated by comparison of the percent sequence identity between the polypeptide encoded by a variant polynucleotide and the polypeptide encoded by the reference polynucleotide. Thus, for example, an isolated polynucleotide that encodes a polypeptide with a given percent sequence identity to the polypeptide are disclosed. Percent sequence identity between any two polypeptides can be calculated using sequence alignment programs and parameters described elsewhere herein. Where any given pair of polynucleotides provided herein is evaluated by comparison of the percent sequence identity shared by the two polypeptides they encode, the percent sequence identity between the two encoded polypeptides is at least about 40%, 45%, 50%, 55%, 60%, 65%, 70%, 75%, 80%, 85%, 90%, 91%, 92%, 93%, 94%, 95%, 96%, 97%, 98%, 99% or more sequence identity.

"Variant" protein is intended to mean a protein derived from the native protein by deletion (so-called truncation) of one or more amino acids at the N-terminal and/or C-terminal end of the native protein; deletion and/or addition of one or more amino acids at one or more internal sites in the native protein; or substitution of one or more amino acids at one or more sites in the native protein. Variant proteins employed in the methods and compositions provided herein are biologically active, that is they continue to possess the desired biological activity of the native protein. Such variants may result from, for example, genetic polymorphism or from human manipulation. Biologically active variants of a native protein provided herein will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to the amino acid sequence for the native protein as determined by sequence alignment programs and parameters described elsewhere herein. A biologically active variant of a protein provided herein may differ from that protein by as few as 1-15 amino acid residues, as few as 1-10, such as 6-10, as few as 5, as few as 4, 3, 2, or even 1 amino acid residue.

Proteins may be altered in various ways including amino acid substitutions, deletions, truncations, and insertions. Methods for such manipulations are generally known in the art. For example, amino acid sequence variants of the recombinase proteins can be prepared by mutations in the DNA. Methods for mutagenesis and nucleotide sequence alterations are well known in the art. See, for example, Kunkel (1985) *Proc. Natl. Acad. Sci. USA* 82:488-492; Kunkel et al. (1987) *Methods in Enzymol.* 154:367-382; U.S. Pat. No. 4,873,192; Walker and Gaastra, eds. (1983) *Techniques in Molecular Biology* (MacMillan Publishing Company, New York) and the references cited therein. Guidance as to appropriate amino acid substitutions that do not affect biological activity of the protein of interest may be found in the model of Dayhoff et al. (1978) *Atlas of Protein Sequence and Structure* (Natl. Biomed. Res. Found., Washington, D.C.), herein incorporated by reference. Conservative substitutions, such as exchanging one amino acid with another having similar properties, may be preferable.

Thus, the polynucleotides used herein can include the naturally occurring sequences, the "native" sequences, as well as mutant forms. Likewise, the proteins used in the methods provided herein encompass both naturally occurring proteins as well as variations and modified forms thereof. Obviously, the mutations that will be made in the polynucleotide encoding the variant polypeptide must not place the sequence out of reading frame and preferably will not create complementary regions that could produce secondary mRNA structure. See, EP Patent Application Publication No. 75,444.

The deletions, insertions, and substitutions of the protein sequences encompassed herein are not expected to produce radical changes in the characteristics of the protein. However, when it is difficult to predict the exact effect of the substitution, deletion, or insertion in advance of doing so, one skilled in the art will appreciate that the effect will be evaluated by routine screening assays.

Variant polynucleotides and proteins also encompass sequences and proteins derived from a mutagenic and recombinogenic procedure such as DNA shuffling. With such a procedure, for example, one or more different recombinase coding sequences can be manipulated to create a new recombinase protein possessing the desired properties. In this manner, libraries of recombinant polynucleotides are generated from a population of related sequence polynucleotides comprising sequence regions that have substantial sequence identity and can be homologously recombined in vitro or in vivo. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458.

The following terms are used to describe the sequence relationships between two or more nucleic acids or polynucleotides. As used herein, "reference sequence" is a defined sequence used as a basis for sequence comparison. A reference sequence may be a subset or the entirety of a specified sequence; for example, as a segment of a full-length cDNA or gene sequence, or the complete cDNA or gene sequence. As used herein, "comparison window" makes reference to a contiguous and specified segment of a polynucleotide sequence, wherein the polynucleotide sequence in the comparison window may comprise additions or deletions (i.e., gaps) compared to the reference sequence (which does not comprise additions or deletions) for optimal alignment of the two sequences. Generally, the comparison window is at least 20 contiguous nucleotides in length, and optionally can be 30, 40, 50, 100, or longer. Those of skill in the art understand that to avoid a high similarity to a reference sequence due to inclusion of gaps in the polynucleotide sequence a gap penalty is typically introduced and is subtracted from the number of matches.

Sequence relationships can be analyzed and described using computer-implemented algorithms. The sequence relationship between two or more polynucleotides, or two or more polypeptides can be determined by determining the best alignment of the sequences, and scoring the matches and the gaps in the alignment, which yields the percent sequence identity, and the percent sequence similarity. Polynucleotide relationships can also be described based on a comparison of the polypeptides each encodes. Many programs and algorithms for the comparison and analysis of sequences are well-known in the art.

"Sequence identity" or "identity" in the context of nucleic acid or polypeptide sequences refers to the nucleic acid bases or amino acid residues in two sequences that are the same when aligned for maximum correspondence over a specified comparison window.

The term "percentage of sequence identity" refers to the value determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the results by 100 to yield the percentage of sequence identity. Useful examples of percent sequence identities include, but are not limited to, 50%, 55%, 60%, 65%, 70%, 75%, 80%, 85%, 90% or 95%, or any integer percentage from 50% to 100%. These identities can be determined using any of the programs described herein.

Sequence alignments and percent identity or similarity calculations may be determined using a variety of comparison methods designed to detect homologous sequences including, but not limited to, the MegAlign™ program of the LASERGENE bioinformatics computing suite (DNASTAR Inc., Madison, Wis.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

The "Clustal V method of alignment" corresponds to the alignment method labeled Clustal V (described by Higgins and Sharp, (1989) *CABIOS* 5:151-153; Higgins et al., (1992) *Comput Appl Biosci* 8:189-191) and found in the MegAlign™ program of the LASERGENE bioinformatics computing suite (DNASTAR Inc., Madison, Wis.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program.

The "Clustal W method of alignment" corresponds to the alignment method labeled Clustal W (described by Higgins and Sharp, (1989) *CABIOS* 5:151-153; Higgins et al., (1992) *Comput Appl Biosci* 8:189-191) and found in the MegAlign™ v6.1 program of the LASERGENE bioinformatics computing suite (DNASTAR Inc., Madison, Wis.). Default parameters for multiple alignment (GAP PENALTY=10, GAP LENGTH PENALTY=0.2, Delay Divergen Seqs (%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

"BLAST" is a searching algorithm provided by the National Center for Biotechnology Information (NCBI) used to find regions of similarity between biological sequences. The program compares nucleotide or protein sequences to sequence databases and calculates the statistical significance of matches to identify sequences having sufficient similarity to a query sequence such that the similarity would not be predicted to have occurred randomly. BLAST reports the identified sequences and their local alignment to the query sequence.

It is well understood by one skilled in the art that many levels of sequence identity are useful in identifying polypeptides from other species or modified naturally or synthetically wherein such polypeptides have the same or similar function or activity. Useful examples of percent identities include, but are not limited to, 50%, 55%, 60%, 65%, 70%, 75%, 80%, 85%, 90% or 95%, or any integer percentage from 50% to 100%. Indeed, any integer amino acid identity from 50% to 100% may be useful in describing the present disclosure, such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%.

Sequence identity/similarity values can also be obtained using GAP Version 10 (GCG, Accelrys, San Diego, Calif.) using the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix (Henikoff and Henikoff (1989) *Proc. Natl. Acad. Sci USA* 89:10915); or any equivalent program thereof. By "equivalent program" is intended any sequence comparison program that, for any two sequences in question, generates an alignment having identical nucleotide or amino acid residue matches and an identical percent sequence identity when compared to the corresponding alignment generated by GAP Version 10

GAP uses the algorithm of Needleman and Wunsch (1970) *J. Mol. Biol.* 48:443-453, to find the alignment of two complete sequences that maximizes the number of matches and minimizes the number of gaps. GAP considers all possible alignments and gap positions and creates the alignment with the largest number of matched bases and the fewest gaps. It allows for the provision of a gap creation penalty and a gap extension penalty in units of matched bases. GAP must make a profit of gap creation penalty number of matches for each gap it inserts. If a gap extension penalty greater than zero is chosen, GAP must, in addition, make a profit for each gap inserted of the length of the gap times the gap extension penalty. Default gap creation penalty values and gap extension penalty values in Version 10 of the GCG Wisconsin Genetics Software Package for protein sequences are 8 and 2, respectively. For nucleotide sequences the default gap creation penalty is 50 while the default gap extension penalty is 3. The gap creation and gap extension penalties can be expressed as an integer selected from the group of integers consisting of from 0 to 200. Thus, for example, the gap creation and gap extension penalties can be 0, 1, 2, 3, 4, 5, 6, 7, 8, 9, 10, 15, 20, 25, 30, 35, 40, 45, 50, 55, 60, 65 or greater.

GAP presents one member of the family of best alignments. There may be many members of this family, but no other member has a better quality. GAP displays four figures of merit for alignments: Quality, Ratio, Identity, and Similarity. The Quality is the metric maximized in order to align the sequences. Ratio is the quality divided by the number of bases in the shorter segment. Percent Identity is the percent of the symbols that actually match. Percent Similarity is the percent of the symbols that are similar. Symbols that are across from gaps are ignored. A similarity is scored when the scoring matrix value for a pair of symbols is greater than or equal to 0.50, the similarity threshold.

The components of a genomic window, (i.e. double-strand-break target sites, transgenic SSI target sites integrated into a DSB target site, randomly inserted transgenic SSI target sites, and/or genomic loci of interest) can be brought together by various methods to create a complex trait locus.

One such method is by crossing plants comprising various transgenic SSI target sites integrated into one or more DSB target sites and/or genomic loci of interest having in a given genomic window different genomic insertion sites and selecting for plants having undergone a recombination event such that the desired combination of target sites and/or genomic loci of interest are present in the same plant. Such breeding techniques can thereby be employed to create a complex trait locus in a plant. Examples of Complex Trait Loci comprising transgenic SSI target sites and/or genomic loci of interest in a genomic window produced by crossing members of an SSI library of randomly integrated SSI target sites are described U.S. patent application Ser. No. 13/748,704, filed Jan. 24, 2014, incorporated by reference herein. Examples of Complex Trait Loci comprising engineered meganuclease target sites and/or genomic loci of interest in a genomic window produced by breeding are described in U.S. patent application Ser. No. 13/427,138, filed on Mar. 22, 2013. Described herein is a method of producing a Complex Trait Loci by introducing transgenic SSI sites into a DSB target site such as but not limited to a Cas endonuclease target site located in close proximity to a genomic locus of interest (a native gene, a mutated or edited gene, a region of interest on a plant chromosome, a transgene) in a genomic window.

In one embodiment, the method comprises a method of producing a complex trait locus in the genome of a plant comprising: (a) providing a first plant having within a genomic window at least a first transgenic target site for site specific integration integrated into a first Cas9 endonuclease target site, and wherein said genomic window is about 10 cM in length and said first plant does not comprise a first genomic locus of interest; (b) breeding to said first plant a second plant, wherein said second plant comprises in said genomic window the first genomic locus of interest and said second plant does not comprise said first transgenic target site; and, (c) selecting a progeny plant from step (b) comprising said first transgenic target site and said genomic locus of interest; wherein said first transgenic target site and said first genomic locus of interest have different genomic insertion site in said progeny plant.

In one embodiment, the method comprises a method of producing a complex trait locus in the genome of a plant comprising: (a) providing a first plant having within a genomic window at least a first transgenic target site for site specific integration integrated into a first Cas9 endonuclease target site and a second transgenic target site for site specific integration integrated into a second Cas9 endonuclease target site, wherein said genomic window is about 10 cM in length, and wherein said first transgenic target site and said second transgenic target site have a different genomic insertion site, wherein said first plant does not comprise a first genomic locus of interest; (b) breeding to said first plant a second plant, wherein said second plant comprises in said genomic window the first genomic locus of interest, wherein said second plant does not comprise said first transgenic target site or said second transgenic target site in the genomic window; and, (c) selecting a progeny plant from step (b) comprising said first transgenic target site, said second transgenic target site and said first genomic locus of interest; wherein each of said first transgenic target site, said second transgenic target site and said first genomic locus of interest have a different genomic insertion site in said progeny plant. The genomic window can be about 5 cM in length and wherein each of said first transgenic target site, said second transgenic target site, and said genomic locus of interest in said progeny plant segregate independently from one another at a rate of about 5% to 0.1%.

In one embodiment, the method of producing a complex trait locus described herein further comprises (a) breeding to said progeny plant a third plant comprising a second genomic locus of interest, wherein said third plant comprises in said genomic window said second genomic locus of interest, wherein said third plant does not comprise said first transgenic target site, said second transgenic target site or said first genomic locus of interest in said genomic window; and, (b) selecting a second progeny plant from step (a) comprising said first transgenic target site, said second transgenic target site, said first genomic locus of interest, and said second genomic locus of interest; wherein each of said first transgenic target site, said second transgenic target site, said first genomic locus of interest and said second genomic locus of interest have a different genomic insertion site in said second progeny plant; and, wherein each of said first transgenic target site, said second transgenic target site, said first genomic locus of interest, or said second genomic locus of interest in said second progeny plant segregate independently from one another at a rate of about 10% to about 0.1%.

In one embodiment, the method comprises a method of producing a complex trait locus in the genome of a plant comprising
(a) providing a first plant having within a genomic window at least a first transgenic target site for site specific integration integrated into a first Cas9 endonuclease target site, wherein said first plant does not comprise a first genomic locus of interest, and wherein said genomic window: (i) is flanked by at least a first marker comprising SYN12545, SYN12536, SYN14645, PZE-101023852, PZE-101024424, SYN25022, SYN31156, SYN31166 or SYN22238 and at least a second marker comprising SYN12536, SYN14645, PZE-101023852, PZE-101024424, SYN25022, SYN31156, SYN31166, SYN22238 or SYN20196; or, (ii) is flanked by at least a first marker comprising PZE-101205031, PUT-163A-148951459-517, PZE-101205904 or PZE-101206569 and at least a second marker comprising PUT-163A-148951459-517, PZE-101205904, PZE-101206569 or SYN24492; or, (iii) is flanked by at least a first marker comprising PZE-103000166, PZE-103000238, PZE-103000307 or SYN6355 and at least a second marker comprising PZE-103000238, PZE-103000307, SYN6355 or PZE-103001421; or, (iv) is flanked by at least at least a first marker comprising PZE-110099037, PZE-110099048, PZE-110100195 or PZE-110100685 and at least a second marker comprising PZE-110099048, PZE-110100195, PZE-110100685 or PZE-110101412 (b) breeding to said first plant a second plant, wherein said second plant comprises in said genomic window the first genomic locus of interest and said second plant does not comprise said first transgenic target site; and, (c) selecting a progeny plant from step (b) comprising said first transgenic target site and said genomic locus of interest; wherein said first transgenic target site and said first genomic locus of interest have different genomic insertion sites in said progeny plant.

As used herein, "breeding" is the genetic manipulation of living organisms. Plants are bred through techniques that take advantage of the plant's method of pollination. A plant is self-pollinated if pollen from one flower is transferred to the same or another flower of the same plant. A plant is sib-pollinated when individuals within the same family or line are used for pollination. A plant is cross-pollinated if the pollen comes from a flower on a different plant from a different family or line. In a breeding application, a breeder initially selects and crosses two or more parental plants. As used herein, "crossing" can refer to a simple X by Y cross, or the process of backcrossing, depending on the context.

Methods are provided herein to either establish a complex trait locus or to break the complex trait locus apart using breeding techniques. For example, a first plant comprising a first transgenic SSI target site integrated in a DSB target site (or a plant comprising an altered DSB target site) within a genomic window, and the first plant does not comprise a first genomic locus of interest, can be crossed with a second plant comprising the first genomic locus of interest within the same genomic window and the second plant does not comprise said first transgenic SSI target site (or altered DSB target site) within the genomic window. A progeny plant is then selected comprising both the first transgenic SSI target site (or altered DSB target site) and the first genomic locus of interest within the genomic window. Selecting a progeny plant comprising both the transgenic SSI target site and the genomic locus of interest can be done through various methods. For example, a phenotypic analysis can be performed whereby the activity of a marker or an introduced sequence is detected in the progeny plant. Alternative methods that assay for markers which are specific to the genomic locus of interest and the transgenic SSI target site include techniques such as PCR, hybridization, Isozyme electrophoresis, Restriction Fragment Length Polymorphisms (RFLPs), Randomly Amplified Polymorphic DNAs (RAPDs), Arbitrarily Primed PCR (AP-PCR), DNA Amplification Fingerprinting (DAF), Sequence Characterized Amplified Regions (SCARs), Amplified Fragment length Polymorphisms (AFLPs), Simple Sequence Repeats (SSRs), and Single Nucleotide Polymorphisms (SNPs).

In non-limiting embodiments, the complex trait locus can comprise (1) a transgenic SSI target site integrated into a DSB target site and a genomic locus of interest having different genomic insertion sites in said genomic window; (2) 2 transgenic SSI target sites integrated into two DSB target sites and a genomic locus of interest having different genomic insertion sites in said genomic window; (3) 2 transgenic SSI target sites integrated into two DSB target sites and 2 genomic loci of interest having different genomic insertion sites in said genomic window; (4) a genomic locus of interest and a transgenic SSI target site integrated into a DSB target site comprising one or more polynucleotides of interest wherein said genomic locus of interest and transgenic target site have different genomic insertion sites; (5) a transgenic target site integrated into a DSB target site and a genomic locus of interest comprising a transgene, each having a different genomic insertion site; (6) a transgenic target site integrated into a DSB target site and a genomic locus of interest comprising a native trait, each having a different genomic insertion site; (7) a transgenic target site integrated into a DSB target site comprising a first and a second dissimilar recombination sites and a genomic locus of interest, each having a different genomic insertion site; (8) a genomic locus of interest, a first transgenic target site integrated into a first DSB target site comprising a first and a second dissimilar recombination sites and a second transgenic target site integrated into a second DSB target site comprising a third and a fourth dissimilar recombination sites, wherein each of said genomic locus of interest, first transgenic target site and second transgenic target site has a different genomic insertion site; (9) a genomic locus of interest, a first transgenic target site integrated into a DSB target site comprising a first and a second dissimilar recombination sites, a second transgenic target site comprising a third and a fourth dissimilar recombination sites and a third transgenic target site integrated into a third DSB target site comprising a fifth and a sixth dissimilar recombination sites, wherein each of said genomic locus of interest, first transgenic target site, second transgenic target site and third transgenic target site has a different genomic insertion site; (10) a first transgenic target site integrated into a first DSB target site and a second transgenic target site integrated into a second DSB target site wherein the second transgenic target site comprises different dissimilar recombination sites as the first transgenic target site and a genomic locus of interest, each having a different genomic insertion site; (11) a first transgenic target site integrated into a first DSB target site, a second transgenic target site integrated into a second DSB target site wherein the second transgenic target site comprises the same dissimilar recombination sites as the first transgenic target site, and a genomic locus of interest, each having a different genomic insertion site; (12) a first transgenic target site integrated into a first DSB target site, a second transgenic target site integrated into a second DSB target site wherein the dissimilar recombination sites comprise a FRT site or a mutant FRT site, and a genomic locus of interest, each having a different genomic insertion site; (13) a first transgenic target site integrated into a first DSB target site and a second transgenic target site integrated into second DSB target site wherein the dissimilar recombination sites comprise a FRT1, FRT5, a FRT6, a FRT7, a FRT12, or a FRT87 site, and a genomic locus of interest, each having a different genomic insertion site; or (14) a first transgenic target site integrated into a first DSB target site and a second transgenic target site integrated into a second DSB target site wherein the dissimilar recombination sites comprise a FRT1 and a FRT87 site, and a genomic locus of interest, each having a different genomic integration site.

A complex trait locus comprising multiple transgenic SSI target sites integrated into multiple DSB target sites, genomic loci of interest and/or polynucleotides of interest can be produced within a genomic window in the genome of a plant.

A non-limiting example of how two traits can be stacked into the genome at a genetic distance of, for example, 5 cM from each other is described as follows: A first plant comprising a first transgenic target site integrated into a first DSB target site within the genomic window and not having the first genomic locus of interest is crossed to a second transgenic plant, comprising a genomic locus of interest at a different genomic insertion site within the genomic window and the second plant does not comprise the first transgenic target site. About 5% of the plant progeny from this cross will have both the first transgenic target site integrated into a first DSB target site and the first genomic locus of interest integrated at different genomic insertion sites within the genomic window. Progeny plants having both sites in the defined genomic window can be further crossed with a third transgenic plant comprising a second transgenic target site integrated into a second DSB target site and/or a second genomic locus of interest within the defined genomic window and lacking the first transgenic target site and the first genomic locus of interest. Progeny are then selected having the first transgenic target site, the first genomic locus of interest and the second genomic locus of interest integrated at different genomic insertion sites within the genomic window. Such methods can be used to produce a transgenic plant comprising a complex trait locus having at least 1, 2, 3, 4, 5, 6, 7, 8, 9, 10, 11, 12, 13, 14, 15, 16, 17, 19, 19, 20, 21, 22, 23, 24, 25, 26, 27, 28, 29, 30, 31 or more transgenic target sites integrated into DSB target sites and/or genomic loci of interest integrated at different sites within the genomic window. In such a manner, various complex trait loci can be generated.

In one non-limiting embodiment, a method of producing a complex trait locus in the genome of a plant comprises providing a first plant having within a genomic window of about 10 cM in length at least a first transgenic target site integrated into a first DSB target site and does not comprise a first genomic region of interest. The genomic window can be any desired length as described elsewhere herein. The method involves breeding the first plant to a second plant which comprises in a different genomic insertion site within the same genomic window a first genomic locus of interest and does not comprise the first transgenic target site integrated into a first DSB target site, and selecting a progeny plant comprising the first transgenic target site and the genomic locus of interest. In another embodiment, the method further involves providing a first plant having within a genomic window a first transgenic target site integrated into a first DSB target site and a second transgenic target site integrated into a second DSB target site having different genomic insertion sites wherein the first plant does not comprise a genomic locus of interest. Breeding the first plant with a second plant where the second plant comprises a genomic locus of interest within the genomic window and does not comprise the first and second transgenic target sites, and selecting for a progeny plant comprising the first transgenic target site, the second transgenic target site and the genomic locus of interest all having different genomic insertion sites within the genomic window. The first transgenic target site, the second transgenic target site and the genomic locus of interest of the progeny plants can segregate independently from one another at a rate of about 10-0.1%, about 10-0.5%, about 10-1%, about 10-5%, about 9-0.1%, about 9-0.5%, about 9-1%, about 9-5%, about 8-0.1%, about 8-0.5%, about 8-1%, about 8-4%, about 7-0.1%, about 7-0.5%, about 7-1%, about 7-4%, about 6-0.1%, about 6-0.5%, about 6-1%, about 6-3%, about 5-0.1%, about 5-0.5%, about 5-1%, about 4-0.1%, about 4-0.5%, about 4-1%, about 3-0.1%, about 3-0.5%, about 3-1%, about 2-0.1%, about 2-0.5%, about 1-0.1% or about 1-0.5%.

In this way, it is recognized that the plants provided herein can be crossed to produce a complex trait locus comprising any combination of the various genomic windows, double-strand-break target sites, transgenic SSI target sites, genomic loci of interest, and/or polynucleotides of interest described herein.

The previous section describes various methods for creating a complex trait locus by adding transgenic SSI target sites integrated into a DSB target sites and/or genomic loci of interest to a genomic window thereby making a complex trait locus. It is recognized that a complex trait locus can also be altered by removing or breeding-away certain target sites (double-strand-break target sites and/or transgenic SSI target sites) and/or genomic loci of interest. The complex trait loci provided herein are designed such that each altered double-strand-break target sites and/or genomic locus of interest has a different genomic insertion site and can segregate independently. Such a design allows traits to be bred into the genomic window and also to breed traits out of the genomic window.

The breeding methods described above for combining traits into a genomic window can also be employed to remove traits from a genomic window by breeding away the trait.

The method of altering a complex trait locus by breeding away comprises providing a first plant comprising a double-strand-break target sites and/or transgenic SSI target sites and/or genomic locus of interest to be removed and crossing the first plant with a second plant that does not have the particular double-strand-break target sites and/or transgenic SSI target sites and/or genomic locus of interest in the genomic window. The resulting progeny lacking the double-strand-break target sites and/or transgenic SSI target sites and/or genomic locus of interest would then be selected.

The transgenic target sites integrated into a DSB target site provided herein comprise at least one recombination site, as described elsewhere herein, which can be utilized for direct insertion of one or more polynucleotides of interest into the target site. Thus, a complex trait locus comprising various target sites can be manipulated by site-specific integration methods. Such methods are described in detail in WO 99/25821, herein incorporated by reference. This method allows removing, adding and/or replacing various polynucleotides of interest within transgenic target sites of an established complex trait locus by employing site-specific recombination. Alternatively, the transgenic target site can be altered in a plant before the plant is utilized in breeding methods to produce a complex trait locus.

Non-limiting examples of compositions and methods disclosed herein are as follows:

1. A soybean plant, soybean plant part or soybean seed having in its genome a genomic window comprising at least one transgenic target site for site specific integration (SSI) integrated into at least one double-strand-break target site, wherein said genomic window is flanked by:
   a. at least a first marker comprising
   BARC_1.01_Gm01_6984873_T_C,
   BARC_1.01_Gm01_7775299_G_A,
   BARC_1.01_Gm01_7856395_A_C,
   BARC_1.01_Gm01_8569887_A_G,
   BARC_1.01_Gm01_8601858_C_T,
   BARC_1.01_Gm01_8641430_C_T,
   BARC_1.01_Gm01_8674202_A_C,
   BARC_1.01_Gm01_8933345_C_T,
   BARC_1.01_Gm01_8964201_T_C,
   BARC_1.01_Gm01_9014216_T_G,
   BARC_1.01_Gm01_28179606_A_G,
   BARC_1.01_Gm01_28364595_A_G,
   BARC_0.01_Gm01_28536363_G_A,
   BARC_1.01_Gm01_28599526_G_A,
   BARC_0.01_Gm01_28913996_A_G,
   BARC_1.01_Gm01_29284158_A_G,
   BARC_0.01_Gm01_31202345_C_T,
   BARC_1.01_Gm01_31770743_C_T,
   BARC_0.01_Gm01_32683433_G_A, or
   BARC_1.01_Gm01_34327255_C_T; and,
   b. at least a second marker comprising
   BARC_0.01_Gm01_7775299_G_A,
   BARC_1.01_Gm01_7856395_A_C,
   BARC_1.01_Gm01_8569887_A_G,
   BARC_1.01_Gm01_8601858_C_T,
   BARC_1.01_Gm01_8641430_C_T,
   BARC_1.01_Gm01_8674202_A_C,
   BARC_1.01_Gm01_8933345_C_T, BARC_1.01_Gm01_8964201_T_C,
BARC_1.01_Gm01_9014216_T_G,
BARC_1.01_Gm01_28179606_A_G,
BARC_0.01_Gm01_28364595_A_G,
BARC_1.01_Gm01_28536363_G_A,
BARC_0.01_Gm01_28599526_G_A,
BARC_1.01_Gm01_28913996_A_G,
BARC_0.01_Gm01_29284158_A_G,
BARC_1.01_Gm01_31202345_C_T,
BARC_0.01_Gm01_31770743_C_T,
BARC_1.01_Gm01_32683433_G_A,
BARC_0.01_Gm01_34327255_C_T, or
BARC_1.01_Gm01_36994849_A_G.

2. The soybean plant, soybean plant part or soybean seed of embodiment 1, wherein said at least one double-strand-break target site is selected from the group consisting of a zinc finger endonuclease target site, an engineered endonuclease target site, a meganuclease target site, a TALENs target site, and a Cas9 endonuclease target site.

3. The soybean plant, soybean plant part or soybean seed of embodiment 1, wherein said genomic window is not more than 0.1, 0.2, 0.3, 0.4, 0.5, 1, 2, 5, 10 cM in length.

4. The soybean plant, soybean plant part or soybean seed of embodiment 1, wherein said genomic window further comprises a transgene.

5. The soybean plant, soybean plant part or soybean seed of embodiment 4, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

6. The soybean plant, soybean plant part or soybean seed of embodiment 1, wherein said genomic window further comprises at least a second, third, fourth, fifth, sixth, seventh, eighth, ninth, tenth, eleventh, twelfth, thirteenth, fourteenth, fifteenth, or sixteenth transgenic target site for site specific integration integrated into at least a second, third, fourth, fifth, sixth, seventh, eighth, ninth, tenth, eleventh, twelfth, thirteenth, fourteenth, fifteenth, or sixteenth double-strand-break target site.

7. The soybean plant, soybean plant part or soybean seed of embodiment 6, wherein said at least second, third, fourth, fifth, sixth, seventh, eighth, ninth, tenth, eleventh, twelfth, thirteenth, fourteenth, fifteenth, or sixteenth double-strand-break target site is selected from the group consisting of a zinc finger target site, a endonuclease target site, a meganuclease target site, a TALENs target site, a Cas9 endonuclease target site, and any one combination thereof.

8. The soybean plant, soybean plant part or soybean seed of embodiment 1, wherein said at least one transgenic target site for site specific integration comprises a first recombination site and a second recombination site, wherein said first and said second recombination site are dissimilar with respect to one another.

9. The soybean plant, soybean plant part or soybean seed of embodiment 8, wherein said at least one transgenic target site for site specific integration further comprises a polynucleotide of interest flanked by said first recombination site and said second recombination site.

10. The soybean plant, soybean plant part or soybean seed of embodiment 8, wherein the dissimilar recombination sites of said transgenic target site for site specific integration comprises a LOX site, a mutant LOX site, a FRT site or a mutant FRT site.

11. The soybean plant, soybean plant part or soybean seed of embodiment 8, wherein said first recombination site and said second recombination site is selected from the group consisting of a FRT1 site, a FRT5 site, a FRT6 site, a FRT12 site, and a FRT87 site.

12. The soybean plant, soybean plant part or soybean seed of embodiment 1, wherein said genomic window further comprises a transgenic target site for site specific integration located outside a Cas9 endonuclease target site.

13. A soybean plant, soybean plant part or soybean seed having in its genome a genomic window comprising at least one double-strand-break target site, wherein said genomic window is flanked by:
 a. at least a first marker comprising
  BARC_1.01_Gm01_6984873_T_C,
  BARC_1.01_Gm01_7775299_G_A,
  BARC_1.01_Gm01_7856395_A_C,
  BARC_1.01_Gm01_8569887_A_G,
  BARC_1.01_Gm01_8601858_C_T,
  BARC_1.01_Gm01_8641430_C_T,
  BARC_1.01_Gm01_8674202_A_C,
  BARC_1.01_Gm01_8933345_C_T,
  BARC_1.01_Gm01_8964201_T_C,
  BARC_1.01_Gm01_9014216_T_G,
  BARC_1.01_Gm01_28179606_A_G,
  BARC_1.01_Gm01_28364595_A_G,
  BARC_0.01_Gm01_28536363_G_A,
  BARC_1.01_Gm01_28599526_G_A,
  BARC_0.01_Gm01_28913996_A_G,
  BARC_1.01_Gm01_29284158_A_G,
  BARC_0.01_Gm01_31202345_C_T,
  BARC_1.01_Gm01_31770743_C_T,
  BARC_0.01_Gm01_32683433_G_A, or
  BARC_1.01_Gm01_34327255_C_T; and,
 b. at least a second marker comprising
  BARC_0.01_Gm01_7775299_G_A,
  BARC_1.01_Gm01_7856395_A_C,
  BARC_1.01_Gm01_8569887_A_G,
  BARC_1.01_Gm01_8601858_C_T,
  BARC_1.01_Gm01_8641430_C_T,
  BARC_1.01_Gm01_8674202_A_C,
  BARC_1.01_Gm01_8933345_C_T,
  BARC_1.01_Gm01_8964201_T_C,
  BARC_1.01_Gm01_9014216_T_G,
  BARC_1.01_Gm01_28179606_A_G,
  BARC_0.01_Gm01_28364595_A_G,
  BARC_1.01_Gm01_28536363_G_A,
  BARC_0.01_Gm01_28599526_G_A,
  BARC_1.01_Gm01_28913996_A_G,
  BARC_0.01_Gm01_29284158_A_G,
  BARC_1.01_Gm01_31202345_C_T,
  BARC_0.01_Gm01_31770743_C_T,
  BARC_1.01_Gm01_32683433_G_A,
  BARC_0.01_Gm01_34327255_C_T, or
  BARC_1.01_Gm01_36994849_A_G,
 wherein said genomic window comprises a transgene.

14. The soybean plant, soybean plant part or soybean seed of embodiment 13, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

15. The soybean plant, soybean plant part or soybean seed of embodiment 13, wherein said genomic window is not more than 0.1, 0.2, 0.3, 0.4, 0.5, 1, 2, 5, 10 cM in length.

16. The soybean plant, soybean plant part or soybean seed of embodiment 13, wherein said genomic window further comprises at least a second, third, fourth, fifth, sixth, seventh, eighth, ninth, tenth, eleventh, twelfth, thirteenth, fourteenth, fifteenth, or sixteenth double-strand-break target site.
17. The soybean plant, soybean plant part or soybean seed of embodiment 13, wherein said at least one double-strand-break target site is selected from the group consisting of a zinc finger endonuclease target site, an endonuclease target site, a meganuclease target site, a TALENs target site and a Cas9 endonuclease target site.
18. The soybean plant, soybean plant part or soybean seed of embodiment 16, wherein said at least second, third, fourth, fifth, sixth, seventh, eighth, ninth, tenth, eleventh, twelfth, thirteenth, fourteenth, fifteenth, or sixteenth double-strand-break target site is selected from the group consisting of a zinc finger target site, a endonuclease target site, a meganuclease target site, a TALENs target site, a Cas9 endonuclease target site, and any one combination thereof.
19. The soybean plant, soybean plant part or soybean seed of embodiment 13, wherein said genomic window further comprises at least one transgenic target site for site-specific integration, wherein said transgenic target site comprises a first recombination site and a second recombination site, wherein said first and said second recombination site are dissimilar with respect to one another.
20. The soybean plant, soybean plant part or soybean seed of embodiment 19, wherein the dissimilar recombination sites of said at least one transgenic target site for site specific integration comprises a LOX site, a mutant LOX site, a FRT site or a mutant FRT site.
21. The soybean plant, soybean plant part or soybean seed of embodiment 20, wherein said first recombination site and said second recombination site is selected from the group consisting of a FRT1 site, a FRT5 site, a FRT6 site, a FRT12 site, and a FRT87 site.
22. A soybean plant, soybean plant part or soybean seed having in its genome a genomic window comprising at least one altered double-strand-break target site, wherein said genomic window is flanked by:
   a. at least a first marker comprising
      BARC_1.01_Gm01_6984873_T_C,
      BARC_1.01_Gm01_7775299_G_A,
      BARC_1.01_Gm01_7856395_A_C,
      BARC_1.01_Gm01_8569887_A_G,
      BARC_1.01_Gm01_8601858_C_T,
      BARC_1.01_Gm01_8641430_C_T,
      BARC_1.01_Gm01_8674202_A_C,
      BARC_1.01_Gm01_8933345_C_T,
      BARC_1.01_Gm01_8964201_T_C,
      BARC_1.01_Gm01_9014216_T_G,
      BARC_1.01_Gm01_28179606_A_G,
      BARC_1.01_Gm01_28364595_A_G,
      BARC_0.01_Gm01_28536363_G_A,
      BARC_1.01_Gm01_28599526_G_A,
      BARC_0.01_Gm01_28913996_A_G,
      BARC_1.01_Gm01_29284158_A_G,
      BARC_0.01_Gm01_31202345_C_T,
      BARC_1.01_Gm01_31770743_C_T,
      BARC_0.01_Gm01_32683433_G_A, or
      BARC_1.01_Gm01_34327255_C_T; and,
   b. at least a second marker comprising
      BARC_1.01_Gm01_7775299_G_A,
      BARC_1.01_Gm01_7856395_A_C,
      BARC_1.01_Gm01_8569887_A_G,
      BARC_1.01_Gm01_8601858_C_T,
      BARC_1.01_Gm01_8641430_C_T,
      BARC_1.01_Gm01_8674202_A_C,
      BARC_1.01_Gm01_8933345_C_T,
      BARC_1.01_Gm01_8964201_T_C,
      BARC_1.01_Gm01_9014216_T_G,
      BARC_1.01_Gm01_28179606_A_G,
      BARC_0.01_Gm01_28364595_A_G,
      BARC_1.01_Gm01_28536363_G_A,
      BARC_0.01_Gm01_28599526_G_A,
      BARC_1.01_Gm01_28913996_A_G,
      BARC_0.01_Gm01_29284158_A_G,
      BARC_1.01_Gm01_31202345_C_T,
      BARC_0.01_Gm01_31770743_C_T,
      BARC_1.01_Gm01_32683433_G_A,
      BARC_0.01_Gm01_34327255_C_T, or
      BARC_1.01_Gm01_36994849_A_G
23. The soybean plant, soybean plant part or soybean seed of embodiment 22, wherein said genomic window is not more than 0.1, 0.2, 0.3, 0.4, 0.5, 1, 2, 5, 10 cM in length.
24. The soybean plant, soybean plant part or soybean seed of embodiment 22, wherein said altered double-strand-break target site originated from a double-strand-break site selected from the group of a zinc finger target site, a endonuclease target site, a meganuclease target site, a TALENs target site, a Cas9 endonuclease target site.
25. The soybean plant, soybean plant part or soybean seed of embodiment 22, wherein said altered double-strand-break target site comprises a polynucleotide of interest.
26. The soybean plant, soybean plant part or soybean seed of embodiment 25, wherein said polynucleotide of interest comprises a transgene, a native gene, an edited gene, or any combination thereof.
27. The soybean plant, soybean plant part or soybean seed of embodiment 22, wherein said genomic window further comprises at least a second, third, fourth, fifth, sixth, seventh, eighth, ninth, tenth, eleventh, twelfth, thirteenth, fourteenth, fifteenth, or sixteenth double-strand-break target site.
28. The soybean plant, soybean plant part or soybean seed of embodiment 27, wherein said at least second, third, fourth, fifth, sixth, seventh, eighth, ninth, tenth, eleventh, twelfth, thirteenth, fourteenth, fifteenth, or sixteenth double-strand-break target site is selected from the group of a zinc finger target site, a endonuclease target site, a meganuclease target site, a TALENs target site, a Cas9 endonuclease target site or any one combination thereof.
29. The soybean plant, soybean plant part or soybean seed of embodiment 25, wherein the polynucleotide of interest confers a trait comprising male sterility, site-specific recombination, abiotic stress tolerance, altered phosphorus, altered antioxidants, altered fatty acids, altered essential amino acids, altered carbohydrates, herbicide tolerance, insect resistance or disease resistance.
30. The soybean plant, soybean plant part or soybean seed of embodiment 22, wherein said genomic window further comprises at least one transgenic target site for site-specific integration comprising a first recombination site and a second recombination site, wherein said first and said second recombination site are dissimilar with respect to one another.
31. The soybean plant, soybean plant part or soybean seed of embodiment 30 wherein the dissimilar recombination sites of said at least one transgenic target site for site specific integration comprises a LOX site, a mutant LOX site, a FRT site or a mutant FRT site.

32. The soybean plant, soybean plant part or soybean seed of embodiment 30, wherein the first recombination site and second recombination site are selected from the group consisting of a FRT1 site, a FRT5 site, a FRT6 site, a FRT12 site and a FRT87 site.

33. A soybean plant, soybean plant part or soybean seed having in its genome a genomic window comprising at least one transgenic target site for site specific integration (SSI) integrated into at least one double-strand-break target site, wherein said genomic window is flanked by:
  a. at least a first marker comprising
    BARC_1.01_Gm06_46915875_T_C,
    BARC_1.01_Gm06_47524452_G_T,
    BARC_1.01_Gm06_47561262_C_T,
    BARC_1.01_Gm06_47625670_C_T,
    BARC_1.01_Gm06_47631544_T_C,
    BARC_1.01_Gm06_47789229_C_T,
    BARC_1.01_Gm06_47821576_T_G,
    BARC_1.01_Gm06_47829363_A_C,
    BARC_1.01_Gm06_47833095_A_G,
    BARC_1.01_Gm06_47847021_G_T,
    BARC_1.01_Gm06_47895876_G_A, or
    BARC_1.01_Gm06_48221293_T_C; and,
  b. at least a second marker comprising
    BARC_1.01_Gm06_47524452_G_T,
    BARC_1.01_Gm06_47561262_C_T,
    BARC_1.01_Gm06_47625670_C_T,
    BARC_1.01_Gm06_47631544_T_C,
    BARC_1.01_Gm06_47789229_C_T,
    BARC_1.01_Gm06_47821576_T_G,
    BARC_1.01_Gm06_47829363_A_C,
    BARC_1.01_Gm06_47833095_A_G,
    BARC_1.01_Gm06_47847021_G_T,
    BARC_1.01_Gm06_47895876_G_A,
    BARC_1.01_Gm06_48221293_T_C, or
    BARC_1.01_Gm06_48528885_G_T.

34. The soybean plant, soybean plant part or soybean seed of embodiment 33, wherein said at least one double-strand-break target site is selected from the group consisting of a zinc finger endonuclease target site, an engineered endonuclease target site, a meganuclease target site, a TALENs target site, and a Cas9 endonuclease target site.

35. The soybean plant, soybean plant part or soybean seed of embodiment 33, wherein said genomic window is not more than 0.1, 0.2, 0.3, 0.4, 0.5, 1, 2, 5, 10 cM in length.

36. The soybean plant, soybean plant part or soybean seed of embodiment 33, wherein said genomic window further comprises a transgene.

37. The soybean plant, soybean plant part or soybean seed of embodiment 36, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

38. The soybean plant, soybean plant part or soybean seed of embodiment 33, wherein said genomic window further comprises at least a second, third, fourth, fifth, sixth, seventh, eighth, ninth, or tenth transgenic target site for site specific integration integrated into at least a second, third, fourth, fifth, sixth, seventh, eighth, ninth or tenth double-strand-break target site.

39. The soybean plant, soybean plant part or soybean seed of embodiment 38, wherein said at least second, third, fourth, fifth, sixth, seventh, eighth, ninth, or tenth double-strand-break target site is selected from the group consisting of a zinc finger target site, a endonuclease target site, a meganuclease target site, a TALENs target site, a Cas9 endonuclease target site, and any one combination thereof.

40. The soybean plant, soybean plant part or soybean seed of embodiment 33, wherein said at least one transgenic target site for site specific integration comprises a first recombination site and a second recombination site, wherein said first and said second recombination site are dissimilar with respect to one another.

41. The soybean plant, soybean plant part or soybean seed of embodiment 40, wherein said at least one transgenic target site for site specific integration further comprises a polynucleotide of interest flanked by said first recombination site and said second recombination site.

42. The soybean plant, soybean plant part or soybean seed of embodiment 40, wherein the dissimilar recombination sites of said transgenic target site for site specific integration comprises a LOX site, a mutant LOX site, a FRT site or a mutant FRT site.

43. The soybean plant, soybean plant part or soybean seed of embodiment 40, wherein said first recombination site and said second recombination site is selected from the group consisting of a FRT1 site, a FRT5 site, a FRT6 site, a FRT12 site, and a FRT87 site.

44. The soybean plant, soybean plant part or soybean seed of embodiment 33, wherein said genomic window further comprises a transgenic target site for site specific integration located outside a Cas9 endonuclease target site.

45. A soybean plant, soybean plant part or soybean seed having in its genome a genomic window comprising at least one double-strand-break target site, wherein said genomic window is flanked by:
  a. at least a first marker comprising
    BARC_101_Gm06_46915875_T_C,
    BARC_1.01_Gm06_47524452_G_T,
    BARC_1.01_Gm06_47561262_C_T,
    BARC_1.01_Gm06_47625670_C_T,
    BARC_1.01_Gm06_47631544_T_C,
    BARC_1.01_Gm06_47789229_C_T,
    BARC_1.01_Gm06_47821576_T_G,
    BARC_1.01_Gm06_47829363_A_C,
    BARC_1.01_Gm06_47833095_A_G,
    BARC_1.01_Gm06_47847021_G_T,
    BARC_1.01_Gm06_47895876_G_A, or
    BARC_1.01_Gm06_48221293_T_C; and,
  b. at least a second marker comprising
    BARC_1.01_Gm06_47524452_G_T,
    BARC_1.01_Gm06_47561262_C_T,
    BARC_101_Gm06_47625670_C_T,
    BARC_1.01_Gm06_47631544_T_C,
    BARC_1.01_Gm06_47789229_C_T,
    BARC_1.01_Gm06_47821576_T_G,
    BARC_1.01_Gm06_47829363_A_C,
    BARC_1.01_Gm06_47833095_A_G,
    BARC_1.01_Gm06_47847021_G_T,
    BARC_1.01_Gm06_47895876_G_A,
    BARC_101_Gm06_48221293_T_C, or
    BARC_1.01_Gm06_48528885_G_T,
  wherein said genomic window comprises a transgene.

46. The soybean plant, soybean plant part or soybean seed of embodiment 45, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

47. The soybean plant, soybean plant part or soybean seed of embodiment 45, wherein said genomic window is not more than 0.1, 0.2, 0.3, 0.4, 0.5, 1, 2, 5, 10 cM in length.

48. The soybean plant, soybean plant part or soybean seed of embodiment 45, wherein said genomic window further comprises at least a second, third, fourth, fifth, sixth, seventh, eighth, ninth, or tenth double-strand-break target site.

49. The soybean plant, soybean plant part or soybean seed of embodiment 45, wherein said at least one double-strand-break target site is selected from the group consisting of a zinc finger endonuclease target site, an endonuclease target site, a meganuclease target site, a TALENs target site and a Cas9 endonuclease target site.

50. The soybean plant, soybean plant part or soybean seed of embodiment 48, wherein said at least second, third, fourth, fifth, sixth, seventh, eighth, ninth, or tenth double-strand-break target site is selected from the group consisting of a zinc finger target site, a endonuclease target site, a meganuclease target site, a TALENs target site, a Cas9 endonuclease target site, and any one combination thereof.

51. The soybean plant, soybean plant part or soybean seed of embodiment 45, wherein said genomic window further comprises at least one transgenic target site for site-specific integration, wherein said transgenic target site comprises a first recombination site and a second recombination site, wherein said first and said second recombination site are dissimilar with respect to one another.

52. The soybean plant, soybean plant part or soybean seed of embodiment 51, wherein the dissimilar recombination sites of said at least one transgenic target site for site specific integration comprises a LOX site, a mutant LOX site, a FRT site or a mutant FRT site.

53. The soybean plant, soybean plant part or soybean seed of embodiment 52, wherein said first recombination site and said second recombination site is selected from the group consisting of a FRT1 site, a FRT5 site, a FRT6 site, a FRT12 site, and a FRT87 site.

54. A soybean plant, soybean plant part or soybean seed having in its genome a genomic window comprising at least one altered double-strand-break target site, wherein said genomic window is flanked by:
   a. at least a first marker comprising
      BARC_1.01_Gm06_46915875_T_C,
      BARC_1.01_Gm06_47524452_G_T,
      BARC_1.01_Gm06_47561262_C_T,
      BARC_1.01_Gm06_47625670_C_T,
      BARC_1.01_Gm06_47631544_T_C,
      BARC_1.01_Gm06_47789229_C_T,
      BARC_1.01_Gm06_47821576_T_G,
      BARC_1.01_Gm06_47829363_A_C,
      BARC_1.01_Gm06_47833095_A_G,
      BARC_1.01_Gm06_47847021_G_T,
      BARC_1.01_Gm06_47895876_G_A, or
      BARC_1.01_Gm06_48221293_T_C; and,
   b. at least a second marker comprising
      BARC_1.01_Gm06_47524452_G_T,
      BARC_1.01_Gm06_47561262_C_T,
      BARC_1.01_Gm06_47625670_C_T,
      BARC_1.01_Gm06_47631544_T_C,
      BARC_1.01_Gm06_47789229_C_T,
      BARC_1.01_Gm06_47821576_T_G,
      BARC_1.01_Gm06_47829363_A_C,
      BARC_1.01_Gm06_47833095_A_G,
      BARC_1.01_Gm06_47847021_G_T,
      BARC_1.01_Gm06_47895876_G_A,
      BARC_1.01_Gm06_48221293_T_C, or
      BARC_1.01_Gm06_48528885_G_T.

55. The soybean plant, soybean plant part or soybean seed of embodiment 54, wherein said genomic window is not more than 0.1, 0.2, 0.3, 0.4, 0.5, 1, 2, 5, 10 cM in length.

56. The soybean plant, soybean plant part or soybean seed of embodiment 54, wherein said altered double-strand-break target site originated from a double-strand-break site selected from the group of a zinc finger target site, a endonuclease target site, a meganuclease target site, a TALENs target site, a Cas9 endonuclease target site.

57. The soybean plant, soybean plant part or soybean seed of embodiment 54, wherein said altered double-strand-break target site comprises a polynucleotide of interest.

58. The soybean plant, soybean plant part or soybean seed of embodiment 57, wherein said polynucleotide of interest comprises a transgene, a native gene, an edited gene, or any combination thereof.

59. The soybean plant, soybean plant part or soybean seed of embodiment 54, wherein said genomic window further comprises at least a second, third, fourth, fifth, sixth, seventh, eighth, ninth, or tenth, double-strand-break target site.

60. The soybean plant, soybean plant part or soybean seed of embodiment 59, wherein said at least second, third, fourth, fifth, sixth, seventh, eighth, ninth, or tenth double-strand-break target site is selected from the group of a zinc finger target site, a endonuclease target site, a meganuclease target site, a TALENs target site, a Cas9 endonuclease target site or any one combination thereof.

61. The soybean plant, soybean plant part or soybean seed of embodiment 57, wherein the polynucleotide of interest confers a trait comprising male sterility, site-specific recombination, abiotic stress tolerance, altered phosphorus, altered antioxidants, altered fatty acids, altered essential amino acids, altered carbohydrates, herbicide tolerance, insect resistance or disease resistance.

62. The soybean plant, soybean plant part or soybean seed of embodiment 54, wherein said genomic window further comprises at least one transgenic target site for site-specific integration comprising a first recombination site and a second recombination site, wherein said first and said second recombination site are dissimilar with respect to one another.

63. The soybean plant, soybean plant part or soybean seed of embodiment 62 wherein the dissimilar recombination sites of said at least one transgenic target site for site specific integration comprises a LOX site, a mutant LOX site, a FRT site or a mutant FRT site.

64. The soybean plant, soybean plant part or soybean seed of embodiment 62, wherein the first recombination site and second recombination site are selected from the group consisting of a FRT1 site, a FRT5 site, a FRT6 site, a FRT12 site and a FRT87 site.

65. A soybean plant, soybean plant part or soybean seed having in its genome a genomic window comprising at least one transgenic target site for site specific integration (SSI) integrated into at least one double-strand-break target site, wherein said genomic window is flanked by:
   a. at least a first marker comprising
      BARC_1.01_Gm04_45591011_C_T,
      BARC_1.01_Gm04_45613405_T_C,
      BARC_1.01_Gm04_45697256_G_A,
      BARC_1.01_Gm04_45739051_A_C,
      BARC_1.01_Gm04_45800267_T_C, BARC_1.01_Gm04_45857325_T_C,
BARC_1.01_Gm04_45857325_T_C,
BARC_1.01_Gm04_45883080_A_G,
BARC_1.01_Gm04_45903617_T_C, or
BARC_1.01_Gm04_46000185_C_A; and,
b. at least a second marker comprising
BARC_1.01_Gm04_45613405_T_C,
BARC_1.01_Gm04_45697256_G_A,
BARC_1.01_Gm04_45739051_A_C,
BARC_1.01_Gm04_45800267_T_C,
BARC_1.01_Gm04_45857325_T_C,
BARC_1.01_Gm04_45857325_T_C,
BARC_1.01_Gm04_45883080_A_G,
BARC_1.01_Gm04_45903617_T_C,
BARC_1.01_Gm04_46000185_C_A, or
BARC_1.01_Gm04_46113406_T_G.

66. The soybean plant, soybean plant part or soybean seed of embodiment 65, wherein said at least one double-strand-break target site is selected from the group consisting of a zinc finger endonuclease target site, an engineered endonuclease target site, a meganuclease target site, a TALENs target site, and a Cas9 endonuclease target site.

67. The soybean plant, soybean plant part or soybean seed of embodiment 65, wherein said genomic window is not more than 0.1, 0.2, 0.3, 0.4, 0.5, 1, 2, 5, 10 cM in length.

68. The soybean plant, soybean plant part or soybean seed of embodiment 1, wherein said genomic window further comprises a transgene.

69. The soybean plant, soybean plant part or soybean seed of embodiment 68, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

70. The soybean plant, soybean plant part or soybean seed of embodiment 65, wherein said genomic window further comprises at least a second, third, fourth, fifth, sixth, seventh, eighth, ninth, tenth, eleventh, twelfth, thirteenth, or fourteenth transgenic target site for site specific integration integrated into at least a second, third, fourth, fifth, sixth, seventh, eighth, ninth, tenth, eleventh, twelfth, thirteenth, or fourteenth, double-strand-break target site.

71. The soybean plant, soybean plant part or soybean seed of embodiment 70, wherein said at least second, third, fourth, fifth, sixth, seventh, eighth, ninth, tenth, eleventh, twelfth, thirteenth, or fourteenth double-strand-break target site is selected from the group consisting of a zinc finger target site, a endonuclease target site, a meganuclease target site, a TALENs target site, a Cas9 endonuclease target site, and any one combination thereof.

72. The soybean plant, soybean plant part or soybean seed of embodiment 65, wherein said at least one transgenic target site for site specific integration comprises a first recombination site and a second recombination site, wherein said first and said second recombination site are dissimilar with respect to one another.

73. The soybean plant, soybean plant part or soybean seed of embodiment 72, wherein said at least one transgenic target site for site specific integration further comprises a polynucleotide of interest flanked by said first recombination site and said second recombination site.

74. The soybean plant, soybean plant part or soybean seed of embodiment 72, wherein the dissimilar recombination sites of said transgenic target site for site specific integration comprises a LOX site, a mutant LOX site, a FRT site or a mutant FRT site.

75. The soybean plant, soybean plant part or soybean seed of embodiment 72, wherein said first recombination site and said second recombination site is selected from the group consisting of a FRT1 site, a FRT5 site, a FRT6 site, a FRT12 site, and a FRT87 site.

76. The soybean plant, soybean plant part or soybean seed of embodiment 65, wherein said genomic window further comprises a transgenic target site for site specific integration located outside a Cas9 endonuclease target site.

77. A soybean plant, soybean plant part or soybean seed having in its genome a genomic window comprising at least one double-strand-break target site, wherein said genomic window is flanked by:
a. at least a first marker comprising
BARC_1.01_Gm04_45591011_C_T,
BARC_1.01_Gm04_45613405_T_C,
BARC_1.01_Gm04_45697256_G_A,
BARC_1.01_Gm04_45739051_A_C,
BARC_1.01_Gm04_45800267_T_C,
BARC_1.01_Gm04_45857325_T_C,
BARC_1.01_Gm04_45857325_T_C,
BARC_1.01_Gm04_45883080_A_G,
BARC_1.01_Gm04_45903617_T_C, or
BARC_1.01_Gm04_46000185_C_A; and,
b. at least a second marker comprising
BARC_1.01_Gm04_45613405_T_C,
BARC_1.01_Gm04_45697256_G_A,
BARC_1.01_Gm04_45739051_A_C,
BARC_1.01_Gm04_45800267_T_C,
BARC_1.01_Gm04_45857325_T_C,
BARC_1.01_Gm04_45857325_T_C,
BARC_1.01_Gm04_45883080_A_G,
BARC_1.01_Gm04_45903617_T_C,
BARC_1.01_Gm04_46000185_C_A, or
BARC_1.01_Gm04_46113406_T_G, wherein said genomic window comprises a transgene.

78. The soybean plant, soybean plant part or soybean seed of embodiment 77, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

79. The soybean plant, soybean plant part or soybean seed of embodiment 77, wherein said genomic window is not more than 0.1, 0.2, 0.3, 0.4, 0.5, 1, 2, 5, 10 cM in length.

80. The soybean plant, soybean plant part or soybean seed of embodiment 77, wherein said genomic window further comprises at least a second, third, fourth, fifth, sixth, seventh, eighth, ninth, tenth, eleventh, twelfth, thirteenth, or fourteenth double-strand-break target site.

81. The soybean plant, soybean plant part or soybean seed of embodiment 77, wherein said at least one double-strand-break target site is selected from the group consisting of a zinc finger endonuclease target site, an endonuclease target site, a meganuclease target site, a TALENs target site and a Cas9 endonuclease target site.

82. The soybean plant, soybean plant part or soybean seed of embodiment 80, wherein said at least second, third, fourth, fifth, sixth, seventh, eighth, ninth, tenth, eleventh, twelfth, thirteenth or fourteenth double-strand-break target site is selected from the group consisting of a zinc finger target site, a endonuclease target site, a meganuclease target site, a TALENs target site, a Cas9 endonuclease target site, and any one combination thereof.

83. The soybean plant, soybean plant part or soybean seed of embodiment 77, wherein said genomic window further comprises at least one transgenic target site for site-specific integration, wherein said transgenic target site comprises a first recombination site and a second recombination site, wherein said first and said second recombination site are dissimilar with respect to one another.

84. The soybean plant, soybean plant part or soybean seed of embodiment 83, wherein the dissimilar recombination sites of said at least one transgenic target site for site specific integration comprises a LOX site, a mutant LOX site, a FRT site or a mutant FRT site.

85. The soybean plant, soybean plant part or soybean seed of embodiment 84, wherein said first recombination site and said second recombination site is selected from the group consisting of a FRT1 site, a FRT5 site, a FRT6 site, a FRT12 site, and a FRT87 site.

86. A soybean plant, soybean plant part or soybean seed having in its genome a genomic window comprising at least one altered double-strand-break target site, wherein said genomic window is flanked by:
   a. at least a first marker comprising BARC_1.01_Gm04_45591011_C_T, BARC_1.01_Gm04_45613405_T_C, BARC_1.01_Gm04_45697256_G_A, BARC_1.01_Gm04_45739051_A_C, BARC_1.01_Gm04_45800267_T_C, BARC_1.01_Gm04_45857325_T_C, BARC_1.01_Gm04_45857325_T_C, BARC_1.01_Gm04_45883080_A_G, BARC_1.01_Gm04_45903617_T_C, or BARC_1.01_Gm04_46000185_C_A; and,
   b. at least a second marker comprising BARC_1.01_Gm04_45613405_T_C, BARC_1.01_Gm04_45697256_G_A, BARC_1.01_Gm04_45739051_A_C, BARC_1.01_Gm04_45800267_T_C, BARC_1.01_Gm04_45857325_T_C, BARC_1.01_Gm04_45857325_T_C, BARC_1.01_Gm04_45883080_A_G, BARC_1.01_Gm04_45903617_T_C, BARC_1.01_Gm04_46000185_C_A, or BARC_1.01_Gm04_46113406_T_G.

87. The soybean plant, soybean plant part or soybean seed of embodiment 86, wherein said genomic window is not more than 0.1, 0.2, 0.3, 0.4, 0.5, 1, 2, 5, 10 cM in length.

88. The soybean plant, soybean plant part or soybean seed of embodiment 86, wherein said altered double-strand-break target site originated from a double-strand-break site selected from the group of a zinc finger target site, a endonuclease target site, a meganuclease target site, a TALENs target site, a Cas9 endonuclease target site.

89. The soybean plant, soybean plant part or soybean seed of embodiment 86, wherein said altered double-strand-break target site comprises a polynucleotide of interest.

90. The soybean plant, soybean plant part or soybean seed of embodiment 89, wherein said polynucleotide of interest comprises a transgene, a native gene, an edited gene, or any combination thereof.

91. The soybean plant, soybean plant part or soybean seed of embodiment 86, wherein said genomic window further comprises at least a second, third, fourth, fifth, sixth, seventh, eighth, ninth, tenth, eleventh, twelfth, thirteenth or fourteenth double-strand-break target site.

92. The soybean plant, soybean plant part or soybean seed of embodiment 91, wherein said at least second, third, fourth, fifth, sixth, seventh, eighth, ninth, tenth, eleventh, twelfth, thirteenth or fourteenth double-strand-break target site is selected from the group of a zinc finger target site, a endonuclease target site, a meganuclease target site, a TALENs target site, a Cas9 endonuclease target site or any one combination thereof.

93. The soybean plant, soybean plant part or soybean seed of embodiment 89, wherein the polynucleotide of interest confers a trait comprising male sterility, site-specific recombination, abiotic stress tolerance, altered phosphorus, altered antioxidants, altered fatty acids, altered essential amino acids, altered carbohydrates, herbicide tolerance, insect resistance or disease resistance.

94. The soybean plant, soybean plant part or soybean seed of embodiment 86, wherein said genomic window further comprises at least one transgenic target site for site-specific integration comprising a first recombination site and a second recombination site, wherein said first and said second recombination site are dissimilar with respect to one another.

95. The soybean plant, soybean plant part or soybean seed of embodiment 94 wherein the dissimilar recombination sites of said at least one transgenic target site for site specific integration comprises a LOX site, a mutant LOX site, a FRT site or a mutant FRT site.

96. The soybean plant, soybean plant part or soybean seed of embodiment 94, wherein the first recombination site and second recombination site are selected from the group consisting of a FRT1 site, a FRT5 site, a FRT6 site, a FRT12 site and a FRT87 site.

97. A maize plant, maize plant part or maize seed having in its genome a genomic window comprising at least one transgenic target site for site specific integration (SSI) integrated into at least one double-strand-break target site, wherein said genomic window is flanked by:
   a. at least a first marker comprising SYN12545, SYN12536, SYN14645, PZE-101023852, PZE-101024424, SYN25022, SYN31156, SYN31166 or SYN22238; and,
   b. at least a second marker comprising SYN12536, SYN14645, PZE-101023852, PZE-101024424, SYN25022, SYN31156, SYN31166, SYN22238 or SYN20196.

98. The maize plant, maize plant part or maize seed of embodiment 97, wherein said at least one double-strand-break target site is selected from the group consisting of a zinc finger endonuclease target site, an engineered endonuclease target site, a meganuclease target site, a TALENs target site, and a Cas9 endonuclease target site.

99. The maize plant, maize plant part or maize seed of embodiment 97, wherein said genomic window is not more than 0.1, 0.2, 0.3, 0.4, 0.5, 1, 2, 5, 10 cM in length.

100. The maize plant, maize plant part or maize seed of embodiment 97, wherein said genomic window further comprises a transgene.

101. The maize plant, maize plant part or maize seed of embodiment 100, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

102. The maize plant, maize plant part or maize seed of embodiment 97, wherein said genomic window further comprises at least a $1^{st}$, $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$, $18^{th}$, $19^{th}$, $20^{th}$, $21^{st}$, $22^{nd}$, $23^{rd}$, $24^{th}$, $25^{th}$, $26^{th}$, $27^{th}$, $28^{th}$, $29^{th}$, $30^{th}$, or $31^{st}$ transgenic target site for site specific integration integrated into at least a $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$, $18^{th}$, $19^{th}$, $20^{th}$, $21^{st}$, $22^{nd}$, $23^{rd}$, $24^{th}$, $25^{th}$, $26^{th}$, $27^{th}$, $28^{th}$, $29^{th}$, $30^{th}$ or $31^{st}$ double-strand-break target site.

103. The maize plant, maize plant part or maize seed of embodiment 102, wherein said at least $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$, $18^{th}$, $19^{th}$, $20^{th}$, $21^{st}$, $22^{nd}$, $23^{rd}$, $24^{th}$, $25^{th}$, $26^{th}$, $27^{th}$, $28^{th}$, $29^{th}$, $30^{th}$ or $31^{st}$ double-strand-break target site is selected from the group consisting of a zinc finger target site, a endonuclease target site, a meganuclease target site, a TALENs target site, a Cas9 endonuclease target site, and any one combination thereof.

104. The maize plant, maize plant part or maize seed of embodiment 97, wherein said at least one transgenic target site for site specific integration comprises a first recombination site and a second recombination site, wherein said first and said second recombination site are dissimilar with respect to one another.

105. The maize plant, maize plant part or maize seed of embodiment 104, wherein said at least one transgenic target site for site specific integration further comprises a polynucleotide of interest flanked by said first recombination site and said second recombination site.

106. The maize plant, maize plant part or maize seed of embodiment 104, wherein the dissimilar recombination sites of said transgenic target site for site specific integration comprises a LOX site, a mutant LOX site, a FRT site or a mutant FRT site.

107. The maize plant, maize plant part or maize seed of embodiment 104 wherein said first recombination site and said second recombination site is selected from the group consisting of a FRT1 site, a FRT5 site, a FRT6 site, a FRT12 site, and a FRT87 site.

108. The maize plant, maize plant part or maize seed of embodiment 97, wherein said genomic window further comprises a transgenic target site for site specific integration located outside a Cas9 endonuclease target site.

109. A maize plant, maize plant part or maize seed having in its genome a genomic window comprising at least one double-strand-break target site, wherein said genomic window is flanked by:
a. at least a first marker comprising SYN12545, SYN12536, SYN14645, PZE-101023852, PZE-101024424, SYN25022, SYN31156, SYN31166 or SYN22238; and,
b. at least a second marker comprising SYN12536, SYN14645, PZE-101023852, PZE-101024424, SYN25022, SYN31156, SYN31166, SYN22238 or SYN20196,
wherein said genomic window comprises a transgene.

110. The maize plant, maize plant part or maize seed of embodiment 109, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

111. The maize plant, maize plant part or maize seed of embodiment 109, wherein said genomic window is not more than 0.1, 0.2, 0.3, 0.4, 0.5, 1, 2, 5, 10 cM in length.

112. The maize plant, maize plant part or maize seed of embodiment 109, wherein said genomic window further comprises at least a $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$, $18^{th}$, $19^{th}$, $20^{th}$, $21^{st}$, $22^{nd}$, $23^{rd}$, $24^{th}$, $25^{th}$, $26^{th}$, $27^{th}$, $28^{th}$, $29^{th}$, 30th, or $31^{st}$ double-strand-break target site.

113. The maize plant, maize plant part or maize seed of embodiment 109, wherein said at least one double-strand-break target site is selected from the group consisting of a zinc finger endonuclease target site, an endonuclease target site, a meganuclease target site, a TALENs target site and a Cas9 endonuclease target site.

114. The maize plant, maize plant part or maize seed of embodiment 112, wherein said at least a $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$, $18^{th}$, $19^{th}$, $20^{th}$, $21^{st}$, $22^{nd}$, $23^{rd}$, $24^{th}$, $25^{th}$, $26^{th}$, $27^{th}$, $28^{th}$, $29^{th}$, $30^{th}$ or $31^{st}$ double-strand-break target site is selected from the group consisting of a zinc finger target site, a endonuclease target site, a meganuclease target site, a TALENs target site, a Cas9 endonuclease target site, and any one combination thereof.

115. The maize plant, maize plant part or maize seed of embodiment 109, wherein said genomic window further comprises at least one transgenic target site for site-specific integration, wherein said transgenic target site comprises a first recombination site and a second recombination site, wherein said first and said second recombination site are dissimilar with respect to one another.

116. The maize plant, maize plant part or maize seed of embodiment 115, wherein the dissimilar recombination sites of said at least one transgenic target site for site specific integration comprises a LOX site, a mutant LOX site, a FRT site or a mutant FRT site.

117. The maize plant, maize plant part or maize seed of embodiment 116, wherein said first recombination site and said second recombination site is selected from the group consisting of a FRT1 site, a FRT5 site, a FRT6 site, a FRT12 site, and a FRT87 site.

118. A maize plant, maize plant part or maize seed having in its genome a genomic window comprising at least one altered double-strand-break target site, wherein said genomic window is flanked by:
a. at least a first marker comprising SYN12545, SYN12536, SYN14645, PZE-101023852, PZE-101024424, SYN25022, SYN31156, SYN31166 or SYN22238; and,
b. at least a second marker comprising SYN12536, SYN14645, PZE-101023852, PZE-101024424, SYN25022, SYN31156, SYN31166, SYN22238 or SYN20196.

119. The maize plant, maize plant part or maize seed of embodiment 118, wherein said genomic window is not more than 0.1, 0.2, 0.3, 0.4, 0.5, 1, 2, 5, 10 cM in length.

120. The maize plant, maize plant part or maize seed of embodiment 118, wherein said altered double-strand-break target site originated from a double-strand-break site selected from the group of a zinc finger target site, a endonuclease target site, a meganuclease target site, a TALENs target site, a Cas9 endonuclease target site.

121. The maize plant, maize plant part or maize seed of embodiment 118, wherein said altered double-strand-break target site comprises a polynucleotide of interest.

122. The maize plant, maize plant part or maize seed of embodiment 121, wherein said polynucleotide of interest comprises a transgene, a native gene, an edited gene, or any combination thereof.

123. The maize plant, maize plant part or maize seed of embodiment 118, wherein said genomic window further comprises at least a $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$, $18^{th}$, $19^{th}$, $20^{th}$, $21^{st}$, $22^{nd}$, $23^{rd}$, $24^{th}$, $25^{th}$, $26^{th}$, $27^{th}$, $28^{th}$ $29^{th}$ $30^{th}$ or $31^{st}$ double-strand-break target site.

124. The maize plant, maize plant part or maize seed of embodiment 123, wherein said at least a $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$, $18^{th}$, $19^{th}$, $20^{th}$, $21^{st}$, $22^{nd}$, $23^{rd}$, $24^{th}$, $25^{th}$, $26^{th}$, $27^{th}$, $28^{th}$, $29^{th}$, $30^{th}$ or $31^{st}$ double-strand-break target site is selected from the group of a zinc finger target site, a endonuclease target site, a meganuclease target site, a TALENs target site, a Cas9 endonuclease target site or any one combination thereof.

125. The maize plant, maize plant part or maize seed of embodiment 121, wherein the polynucleotide of interest confers a trait comprising male sterility, site-specific recombination, abiotic stress tolerance, altered phosphorus, altered antioxidants, altered fatty acids, altered essential amino acids, altered carbohydrates, herbicide tolerance, insect resistance or disease resistance.

126. The maize plant, maize plant part or maize seed of embodiment 118, wherein said genomic window further comprises at least one transgenic target site for site-specific integration comprising a first recombination site and a second recombination site, wherein said first and said second recombination site are dissimilar with respect to one another.

127. The maize plant, maize plant part or maize seed of embodiment 126 wherein the dissimilar recombination sites of said at least one transgenic target site for site specific integration comprises a LOX site, a mutant LOX site, a FRT site or a mutant FRT site.

128. The maize plant, maize plant part or maize seed of embodiment 126, wherein the first recombination site and second recombination site are selected from the group consisting of a FRT1 site, a FRT5 site, a FRT6 site, a FRT12 site and a FRT87 site.

129. A maize plant, maize plant part or maize seed having in its genome a genomic window comprising at least one transgenic target site for site specific integration (SSI) integrated into at least one double-strand-break target site, wherein said genomic window is flanked by:
 a. at least a first marker comprising PZE-101205031, PUT-163A-148951459-517, PZE-101205904 or PZE-101206569; and,
 b. at least a second marker comprising PUT-163A-148951459-517, PZE-101205904, PZE-101206569 or SYN24492.

130. The maize plant, maize plant part or maize seed of embodiment 129, wherein said at least one double-strand-break target site is selected from the group consisting of a zinc finger endonuclease target site, an engineered endonuclease target site, a meganuclease target site, a TALENs target site, and a Cas9 endonuclease target site.

131. The maize plant, maize plant part or maize seed of embodiment 129, wherein said genomic window is not more than 0.1, 0.2, 0.3, 0.4, 0.5, 1, 2, 5, 10 cM in length.

132. The maize plant, maize plant part or maize seed of embodiment 129, wherein said genomic window further comprises a transgene.

133. The maize plant, maize plant part or maize seed of embodiment 132, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

134. The maize plant, maize plant part or maize seed of embodiment 129, wherein said genomic window further comprises at least a $1^{st}$, $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$ or $15^{th}$ transgenic target site for site specific integration integrated into at least a $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$ or $15^{th}$ double-strand-break target site.

135. The maize plant, maize plant part or maize seed of embodiment 134, wherein said at least $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$ or $15^{th}$ double-strand-break target site is selected from the group consisting of a zinc finger target site, a endonuclease target site, a meganuclease target site, a TALENs target site, a Cas9 endonuclease target site, and any one combination thereof.

136. The maize plant, maize plant part or maize seed of embodiment 129, wherein said at least one transgenic target site for site specific integration comprises a first recombination site and a second recombination site, wherein said first and said second recombination site are dissimilar with respect to one another.

137. The maize plant, maize plant part or maize seed of embodiment 136, wherein said at least one transgenic target site for site specific integration further comprises a polynucleotide of interest flanked by said first recombination site and said second recombination site.

138. The maize plant, maize plant part or maize seed of embodiment 136, wherein the dissimilar recombination sites of said transgenic target site for site specific integration comprises a LOX site, a mutant LOX site, a FRT site or a mutant FRT site.

139. The maize plant, maize plant part or maize seed of embodiment 136 wherein said first recombination site and said second recombination site is selected from the group consisting of a FRT1 site, a FRT5 site, a FRT6 site, a FRT12 site, and a FRT87 site.

140. The maize plant, maize plant part or maize seed of embodiment 129, wherein said genomic window further comprises a transgenic target site for site specific integration located outside a Cas9 endonuclease target site.

141. A maize plant, maize plant part or maize seed having in its genome a genomic window comprising at least one double-strand-break target site, wherein said genomic window is flanked by:
 a. at least a first marker comprising PZE-101205031, PUT-163A-148951459-517, PZE-101205904 or PZE-101206569; and,
 b. at least a second marker comprising PUT-163A-148951459-517, PZE-101205904, PZE-101206569 or SYN24492,
 wherein said genomic window comprises a transgene.

142. The maize plant, maize plant part or maize seed of embodiment 141, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

143. The maize plant, maize plant part or maize seed of embodiment 141, wherein said genomic window is not more than 0.1, 0.2, 0.3, 0.4, 0.5, 1, 2, 5, 10 cM in length.

144. The maize plant, maize plant part or maize seed of embodiment 141, wherein said genomic window further comprises at least $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$ or $15^{th}$ double-strand-break target site.

145. The maize plant, maize plant part or maize seed of embodiment 141, wherein said at least one double-strand-break target site is selected from the group consisting of a zinc finger endonuclease target site, an endonuclease target site, a meganuclease target site, a TALENs target site and a Cas9 endonuclease target site.

146. The maize plant, maize plant part or maize seed of embodiment 144, wherein said at least a $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$ or $15^{th}$ double-strand-break target site is selected from the group consisting of a zinc finger target site, a endonuclease target site, a meganuclease target site, a TALENs target site, a Cas9 endonuclease target site, and any one combination thereof.

147. The maize plant, maize plant part or maize seed of embodiment 141, wherein said genomic window further comprises at least one transgenic target site for site-specific integration, wherein said transgenic target site comprises a first recombination site and a second recombination site, wherein said first and said second recombination site are dissimilar with respect to one another.

148. The maize plant, maize plant part or maize seed of embodiment 147, wherein the dissimilar recombination sites of said at least one transgenic target site for site specific integration comprises a LOX site, a mutant LOX site, a FRT site or a mutant FRT site.

149. The maize plant, maize plant part or maize seed of embodiment 148, wherein said first recombination site and said second recombination site is selected from the group consisting of a FRT1 site, a FRT5 site, a FRT6 site, a FRT12 site, and a FRT87 site.

150. A maize plant, maize plant part or maize seed having in its genome a genomic window comprising at least one altered double-strand-break target site, wherein said genomic window is flanked by:
  a. at least a first marker comprising PZE-101205031, PUT-163A-148951459-517, PZE-101205904 or PZE-101206569; and,
  b. at least a second marker comprising PUT-163A-148951459-517, PZE-101205904, PZE-101206569 or SYN24492.

151. The maize plant, maize plant part or maize seed of embodiment 150, wherein said genomic window is not more than 0.1, 0.2, 0.3, 0.4, 0.5, 1, 2, 5, 10 cM in length.

152. The maize plant, maize plant part or maize seed of embodiment 150, wherein said altered double-strand-break target site originated from a double-strand-break site selected from the group of a zinc finger target site, a endonuclease target site, a meganuclease target site, a TALENs target site, a Cas9 endonuclease target site.

153. The maize plant, maize plant part or maize seed of embodiment 150, wherein said altered double-strand-break target site comprises a polynucleotide of interest.

154. The maize plant, maize plant part or maize seed of embodiment 152, wherein said polynucleotide of interest comprises a transgene, a native gene, an edited gene, or any combination thereof.

155. The maize plant, maize plant part or maize seed of embodiment 150, wherein said genomic window further comprises at least a $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$ or $15^{th}$ double-strand-break target site.

156. The maize plant, maize plant part or maize seed of embodiment 155, wherein said at least a $2^{nd}$, $3^{rd}$, $4^{th}$, $5^{th}$, $6^{th}$, $7^{th}$, $8^{th}$, $9^{th}$ $10^{th}$, $11^{th}$, $12^{th}$, $13^{th}$, $14^{th}$ or $15^{th}$ double-strand-break target site is selected from the group of a zinc finger target site, a endonuclease target site, a meganuclease target site, a TALENs target site, a Cas9 endonuclease target site or any one combination thereof.

157. The maize plant, maize plant part or maize seed of embodiment 152, wherein the polynucleotide of interest confers a trait comprising male sterility, site-specific recombination, abiotic stress tolerance, altered phosphorus, altered antioxidants, altered fatty acids, altered essential amino acids, altered carbohydrates, herbicide tolerance, insect resistance or disease resistance.

158. The maize plant, maize plant part or maize seed of embodiment 150, wherein said genomic window further comprises at least one transgenic target site for site-specific integration comprising a first recombination site and a second recombination site, wherein said first and said second recombination site are dissimilar with respect to one another.

159. The maize plant, maize plant part or maize seed of embodiment 158 wherein the dissimilar recombination sites of said at least one transgenic target site for site specific integration comprises a LOX site, a mutant LOX site, a FRT site or a mutant FRT site.

160. The maize plant, maize plant part or maize seed of embodiment 158, wherein the first recombination site and second recombination site are selected from the group consisting of a FRT1 site, a FRT5 site, a FRT6 site, a FRT12 site and a FRT87 site.

161. A maize plant, maize plant part or maize seed having in its genome a genomic window comprising at least one transgenic target site for site specific integration (SSI) integrated into at least one double-strand-break target site, wherein said genomic window is flanked by:
  a. at least a first marker comprising PZE-103000166, PZE-103000238, PZE-103000307 or SYN6355; and,
  b. at least a second marker comprising PZE-103000238, PZE-103000307, SYN6355 or PZE-103001421.

162. The maize plant, maize plant part or maize seed of embodiment 161, wherein said at least one double-strand-break target site is selected from the group consisting of a zinc finger endonuclease target site, an engineered endonuclease target site, a meganuclease target site, a TALENs target site, and a Cas9 endonuclease target site.

163. The maize plant, maize plant part or maize seed of embodiment 161, wherein said genomic window is not more than 0.1, 0.2, 0.3, 0.4, 0.5, 1, 2, 5, 10 cM in length.

164. The maize plant, maize plant part or maize seed of embodiment 161, wherein said genomic window further comprises a transgene.

165. The maize plant, maize plant part or maize seed of embodiment 164, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

166. The maize plant, maize plant part or maize seed of embodiment 161, wherein said genomic window further comprises at least a $1^{st}$, $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ or $18^{th}$ transgenic target site for site specific integration integrated into at least a $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ or $18^{th}$ double-strand-break target site.

167. The maize plant, maize plant part or maize seed of embodiment 164, wherein said at least $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$, or $18^{th}$ double-strand-break target site is selected from the group consisting of a zinc finger target site, a endonuclease target site, a meganuclease target site, a TALENs target site, a Cas9 endonuclease target site, and any one combination thereof.

168. The maize plant, maize plant part or maize seed of embodiment 161, wherein said at least one transgenic target site for site specific integration comprises a first recombination site and a second recombination site, wherein said first and said second recombination site are dissimilar with respect to one another.

169. The maize plant, maize plant part or maize seed of embodiment 168, wherein said at least one transgenic target site for site specific integration further comprises a polynucleotide of interest flanked by said first recombination site and said second recombination site.

170. The maize plant, maize plant part or maize seed of embodiment 168, wherein the dissimilar recombination sites of said transgenic target site for site specific integration comprises a LOX site, a mutant LOX site, a FRT site or a mutant FRT site.

171. The maize plant, maize plant part or maize seed of embodiment 168 wherein said first recombination site and said second recombination site is selected from the group consisting of a FRT1 site, a FRT5 site, a FRT6 site, a FRT12 site, and a FRT87 site.

172. The maize plant, maize plant part or maize seed of embodiment 161, wherein said genomic window further comprises a transgenic target site for site specific integration located outside a Cas9 endonuclease target site.

173. A maize plant, maize plant part or maize seed having in its genome a genomic window comprising at least one double-strand-break target site, wherein said genomic window is flanked by:
  a. at least a first marker comprising PZE-103000166, PZE-103000238, PZE-103000307 or SYN6355; and,
  b. at least a second marker comprising PZE-103000238, PZE-103000307, SYN6355 or PZE-103001421,
wherein said genomic window comprises a transgene.

174. The maize plant, maize plant part or maize seed of embodiment 173, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

175. The maize plant, maize plant part or maize seed of embodiment 173, wherein said genomic window is not more than 0.1, 0.2, 0.3, 0.4, 0.5, 1, 2, 5, 10 cM in length.

176. The maize plant, maize plant part or maize seed of embodiment 173, wherein said genomic window further comprises at least a $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$, or $18^{th}$ double-strand-break target site.

177. The maize plant, maize plant part or maize seed of embodiment 173, wherein said at least one double-strand-break target site is selected from the group consisting of a zinc finger endonuclease target site, an endonuclease target site, a meganuclease target site, a TALENs target site and a Cas9 endonuclease target site.

178. The maize plant, maize plant part or maize seed of embodiment 176, wherein said at least a $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$, or $18^{th}$ double-strand-break target site is selected from the group consisting of a zinc finger target site, a endonuclease target site, a meganuclease target site, a TALENs target site, a Cas9 endonuclease target site, and any one combination thereof.

179. The maize plant, maize plant part or maize seed of embodiment 173, wherein said genomic window further comprises at least one transgenic target site for site-specific integration, wherein said transgenic target site comprises a first recombination site and a second recombination site, wherein said first and said second recombination site are dissimilar with respect to one another 180. The maize plant, maize plant part or maize seed of embodiment 179, wherein the dissimilar recombination sites of said at least one transgenic target site for site specific integration comprises a LOX site, a mutant LOX site, a FRT site or a mutant FRT site.

181. The maize plant, maize plant part or maize seed of embodiment 179, wherein said first recombination site and said second recombination site is selected from the group consisting of a FRT1 site, a FRT5 site, a FRT6 site, a FRT12 site, and a FRT87 site.

182. A maize plant, maize plant part or maize seed having in its genome a genomic window comprising at least one altered double-strand-break target site, wherein said genomic window is flanked by:
  a. at least a first marker comprising PZE-103000166, PZE-103000238, PZE-103000307 or SYN6355; and,
  b. at least a second marker comprising PZE-103000238, PZE-103000307, SYN6355 or PZE-103001421.

183. The maize plant, maize plant part or maize seed of embodiment 182, wherein said genomic window is not more than 0.1, 0.2, 0.3, 0.4, 0.5, 1, 2, 5, 10 cM in length.

184. The maize plant, maize plant part or maize seed of embodiment 182, wherein said altered double-strand-break target site originated from a double-strand-break site selected from the group of a zinc finger target site, a endonuclease target site, a meganuclease target site, a TALENs target site, a Cas9 endonuclease target site.

185. The maize plant, maize plant part or maize seed of embodiment 182, wherein said altered double-strand-break target site comprises a polynucleotide of interest.

186. The maize plant, maize plant part or maize seed of embodiment 184, wherein said polynucleotide of interest comprises a transgene, a native gene, an edited gene, or any combination thereof.

187. The maize plant, maize plant part or maize seed of embodiment 182, wherein said genomic window further comprises at least $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$, $15^{th}$, $16^{th}$, $17^{th}$ or $18^{th}$ double-strand-break target site.

188. The maize plant, maize plant part or maize seed of embodiment 187, wherein said at least a 2nd, 3rd, 4th, 5th, 6th, 7th, 8th, 9th, 10th, 11th, 12th, 13th, 14th, 15th, 16th, 17th or 18th double-strand-break target site is selected from the group of a zinc finger target site, a endonuclease target site, a meganuclease target site, a TALENs target site, a Cas9 endonuclease target site or any one combination thereof.

189. The maize plant, maize plant part or maize seed of embodiment 184, wherein the polynucleotide of interest confers a trait comprising male sterility, site-specific recombination, abiotic stress tolerance, altered phosphorus, altered antioxidants, altered fatty acids, altered essential amino acids, altered carbohydrates, herbicide tolerance, insect resistance or disease resistance.

190. The maize plant, maize plant part or maize seed of embodiment 182, wherein said genomic window further comprises at least one transgenic target site for site-specific integration comprising a first recombination site and a second recombination site, wherein said first and said second recombination site are dissimilar with respect to one another.

191. The maize plant, maize plant part or maize seed of embodiment 190 wherein the dissimilar recombination sites of said at least one transgenic target site for site specific integration comprises a LOX site, a mutant LOX site, a FRT site or a mutant FRT site.

192. The maize plant, maize plant part or maize seed of embodiment 190, wherein the first recombination site and second recombination site are selected from the group consisting of a FRT1 site, a FRT5 site, a FRT6 site, a FRT12 site and a FRT87 site.

193. A maize plant, maize plant part or maize seed having in its genome a genomic window comprising at least one transgenic target site for site specific integration (SSI) integrated into at least one double-strand-break target site, wherein said genomic window is flanked by:
  a. at least a first marker comprising PZE-110099037, PZE-110099048, PZE-110100195 or PZE-110100685; and,
  b. at least a second marker comprising PZE-110099048, PZE-110100195, PZE-110100685 or PZE-110101412.

194. The maize plant, maize plant part or maize seed of embodiment 193, wherein said at least one double-strand-break target site is selected from the group consisting of a zinc finger endonuclease target site, an engineered endonuclease target site, a meganuclease target site, a TALENs target site, and a Cas9 endonuclease target site.

195. The maize plant, maize plant part or maize seed of embodiment 193, wherein said genomic window is not more than 0.1, 0.2, 0.3, 0.4, 0.5, 1, 2, 5, 10 cM in length.

196. The maize plant, maize plant part or maize seed of embodiment 193, wherein said genomic window further comprises a transgene.

197. The maize plant, maize plant part or maize seed of embodiment 194, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

198. The maize plant, maize plant part or maize seed of embodiment 193, wherein said genomic window further comprises at least a $1^{st}$, $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$ or $15^{th}$ transgenic target site for site specific integration integrated into at least a $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$ or $15^{th}$ double-strand-break target site.

199. The maize plant, maize plant part or maize seed of embodiment 198, wherein said at least $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$ or $15^{th}$ double-strand-break target site is selected from the group consisting of a zinc finger target site, a endonuclease target site, a meganuclease target site, a TALENs target site, a Cas9 endonuclease target site, and any one combination thereof.

200. The maize plant, maize plant part or maize seed of embodiment 193, wherein said at least one transgenic target site for site specific integration comprises a first recombination site and a second recombination site, wherein said first and said second recombination site are dissimilar with respect to one another.

201. The maize plant, maize plant part or maize seed of embodiment 200, wherein said at least one transgenic target site for site specific integration further comprises a polynucleotide of interest flanked by said first recombination site and said second recombination site.

202. The maize plant, maize plant part or maize seed of embodiment 200, wherein the dissimilar recombination sites of said transgenic target site for site specific integration comprises a LOX site, a mutant LOX site, a FRT site or a mutant FRT site.

203. The maize plant, maize plant part or maize seed of embodiment 200 wherein said first recombination site and said second recombination site is selected from the group consisting of a FRT1 site, a FRT5 site, a FRT6 site, a FRT12 site, and a FRT87 site.

204. The maize plant, maize plant part or maize seed of embodiment 193, wherein said genomic window further comprises a transgenic target site for site specific 205. A maize plant, maize plant part or maize seed having in its genome a genomic window comprising at least one double-strand-break target site, wherein said genomic window is flanked by:
  a. at least a first marker comprising PZE-110099037, PZE-110099048, PZE-110100195 or PZE-110100685; and,
  b. at least a second marker comprising PZE-110099048, PZE-110100195, PZE-110100685 or PZE-110101412, wherein said genomic window comprises a transgene.

206. plant, maize plant part or maize seed of embodiment 205, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

207. The maize plant, maize plant part or maize seed of embodiment 205, wherein said genomic window is not more than 0.1, 0.2, 0.3, 0.4, 0.5, 1, 2, 5, 10 cM in length.

208. The maize plant, maize plant part or maize seed of embodiment 205, wherein said genomic window further comprises at least $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$ or $15^{th}$ double-strand-break target site.

209. The maize plant, maize plant part or maize seed of embodiment 205, wherein said at least one double-strand-break target site is selected from the group consisting of a zinc finger endonuclease target site, an endonuclease target site, a meganuclease target site, a TALENs target site and a Cas9 endonuclease target site.

210. The maize plant, maize plant part or maize seed of embodiment 208, wherein said at least a $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$ or $15^{th}$ double-strand-break target site is selected from the group consisting of a zinc finger target site, a endonuclease target site, a meganuclease target site, a TALENs target site, a Cas9 endonuclease target site, and any one combination thereof.

211. The maize plant, maize plant part or maize seed of embodiment 205, wherein said genomic window further comprises at least one transgenic target site for site-specific integration, wherein said transgenic target site comprises a first recombination site and a second recombination site, wherein said first and said second recombination site are dissimilar with respect to one another.

212. The maize plant, maize plant part or maize seed of embodiment 211, wherein the dissimilar recombination sites of said at least one transgenic target site for site specific integration comprises a LOX site, a mutant LOX site, a FRT site or a mutant FRT site.
213. The maize plant, maize plant part or maize seed of embodiment 211, wherein said first recombination site and said second recombination site is selected from the group consisting of a FRT1 site, a FRT5 site, a FRT6 site, a FRT12 site, and a FRT87 site.
214. A maize plant, maize plant part or maize seed having in its genome a genomic window comprising at least one altered double-strand-break target site, wherein said genomic window is flanked by:
  a. at least a first marker comprising PZE-110099037, PZE-110099048, PZE-110100195 or PZE-110100685; and,
  b. at least a second marker comprising PZE-110099048, PZE-110100195, PZE-110100685 or PZE-110101412.
215. The maize plant, maize plant part or maize seed of embodiment 214, wherein said genomic window is not more than 0.1, 0.2, 0.3, 0.4, 0.5, 1, 2, 5, 10 cM in length.
216. The maize plant, maize plant part or maize seed of embodiment 214, wherein said altered double-strand-break target site originated from a double-strand-break site selected from the group of a zinc finger target site, a endonuclease target site, a meganuclease target site, a TALENs target site, a Cas9 endonuclease target site.
217. The maize plant, maize plant part or maize seed of embodiment 214, wherein said altered double-strand-break target site comprises a polynucleotide of interest.
218. The maize plant, maize plant part or maize seed of embodiment 217, wherein said polynucleotide of interest comprises a transgene, a native gene, an edited gene, or any combination thereof.
219. The maize plant, maize plant part or maize seed of embodiment 214, wherein said genomic window further comprises at least a $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$ or $15^{th}$ double-strand-break target site.
220. The maize plant, maize plant part or maize seed of embodiment 219, wherein said at least a $2^{nd}$, $3^{rd}$, $4^{th}$, $5^{th}$, $6^{th}$, $7^{th}$, $8^{th}$, $9^{th}$, $10^{th}$, $11^{th}$, $12^{th}$, $13^{th}$, $14^{th}$ or $15^{th}$ double-strand-break target site is selected from the group of a zinc finger target site, a endonuclease target site, a meganuclease target site, a TALENs target site, a Cas9 endonuclease target site or any one combination thereof.
221. The maize plant, maize plant part or maize seed of embodiment 217, wherein the polynucleotide of interest confers a trait comprising male sterility, site-specific recombination, abiotic stress tolerance, altered phosphorus, altered antioxidants, altered fatty acids, altered essential amino acids, altered carbohydrates, herbicide tolerance, insect resistance or disease resistance.
222. The maize plant, maize plant part or maize seed of embodiment 214, wherein said genomic window further comprises at least one transgenic target site for site-specific integration comprising a first recombination site and a second recombination site, wherein said first and said second recombination site are dissimilar with respect to one another.
223. The maize plant, maize plant part or maize seed of embodiment 222 wherein the dissimilar recombination sites of said at least one transgenic target site for site specific integration comprises a LOX site, a mutant LOX site, a FRT site or a mutant FRT site.
224. The maize plant, maize plant part or maize seed of embodiment 222, wherein the first recombination site and second recombination site are selected from the group consisting of a FRT1 site, a FRT5 site, a FRT6 site, a FRT12 site and a FRT87 site.
225. A plant, plant part or seed having in its genome at least one transgenic target site for site specific integration (SSI) integrated into at least one Cas endonuclease target site.
226. The plant, plant part or seed of embodiment 225 wherein the Cas endonuclease target site is a Cas9 endonuclease target site.
227. The plant of embodiment 225, wherein the plant is a monocot or a dicot.
228. The plant of embodiment 227, wherein the monocot is selected from the group consisting of maize, rice, sorghum, rye, barley, wheat, millet, oats, sugarcane, turfgrass, or switchgrass.
229. The plant of embodiment 227, wherein the dicot is selected from the group consisting of soybean, canola, alfalfa, sunflower, cotton, tobacco, peanut, potato, tobacco, *Arabidopsis*, or safflower.
230. A method for introducing into the genome of a plant cell a transgenic target site for site-specific integration, the method comprising:
  (a) providing a plant cell comprising in its genome an endogenous target site for a Cas endonuclease;
  (b) providing a Cas endonuclease and a guide polynucleotide, wherein the Cas endonuclease is capable of forming a complex with said guide polynucleotide, wherein said complex is capable of inducing a double-strand break in said endogenous target site, and wherein the endogenous target site is located between a first and a second genomic region;
  (c) providing a donor DNA comprising the transgenic target site for site-specific integration located between a first region of homology to said first genomic region and a second region of homology to said second genomic region, wherein the transgenic target site comprises a first and a second recombination site, wherein the first and the second recombination sites are dissimilar with respect to one another;
  (d) contacting the plant cell with the guide polynucleotide, the donor DNA and the Cas endonuclease; and,
  (e) identifying at least one plant cell from (d) comprising in its genome the transgenic target site integrated at said endogenous target site.
231. The method of embodiment 230, wherein the first region of homology further comprises a first fragment of said endogenous target site of (a), and wherein the second region of homology comprises a second fragment of said endogenous target site of (a), wherein the first and second fragments are dissimilar.
232. The method of embodiment 230, further comprising recovering a fertile plant from the cell of (d), the fertile plant comprising in its genome the transgenic target site for site-specific integration integrated into the endogenous target site.
233. The method of embodiment 230, wherein the endogenous target site is a 12 to 20 nucleotide sequence adjacent to a protospacer-adjacent motif (PAM) located in a genomic window comprising at least one genomic locus of interest, wherein the genomic window is about 10 cM in length.
234. The method of embodiment 233 wherein said genomic window:
  (a) is flanked by at least a first marker comprising SYN12545, SYN12536, SYN14645, PZE-101023852, PZE-101024424, SYN25022, SYN31156, SYN31166 or SYN22238 and at least a second marker comprising SYN12536, SYN14645, PZE-101023852, PZE-101024424, SYN25022, SYN31156, SYN31166, SYN22238 or SYN20196; or, (b) is flanked by at least a first marker comprising PZE-101205031, PUT-163A-148951459-517, PZE-101205904 or PZE-101206569 and at least a second marker comprising PUT-163A-148951459-517, PZE-101205904, PZE-101206569 or SYN24492; or, (c) is flanked by at least a first marker comprising PZE-103000166, PZE-103000238, PZE-103000307 or SYN6355 and at least a second marker comprising PZE-103000238, PZE-103000307, SYN6355 or PZE-103001421; or, (d) is flanked by at least at least a first marker comprising PZE-110099037, PZE-110099048, PZE-110100195 or PZE-110100685 and at least a second marker comprising PZE-110099048, PZE-110100195, PZE-110100685 or PZE-110101412.

235. The method of embodiment 230, wherein the endogenous target site for a Cas endonuclease is selected from the group consisting of SEQ ID NOs: 3-5, 7-11, 13-19, 21-23, 25-28, 30-34, 36-39, 43-47, 49-52, 54-58, 60, 63-66, 68-72, 74-78, 80-83, 87-90, 92-93, 95-98, 100-104, 317-320, 323-324, 327-328, 331-332, 334-337, 342-343, 346-347, 350-351, 354-355, 358-359, 365-366. 370-371, 376-377, 380-381, 384-385, 388-389, 392-393 and 396-397, or a functional fragment thereof.

236. The method of embodiment 230, wherein the transgenic target site further comprises a polynucleotide of interest between the first recombination site and the second recombination site.

237. The method of embodiment 230, wherein at least one of the first and the second recombination sites comprises an FRT site, a mutant FRT site, a LOX site, and a mutant LOX site.

238. The method of embodiment 230, wherein the transgenic target site further comprises a third recombination site between the first and the second recombination site, wherein the third recombination site is dissimilar to the first and the second recombination sites.

239. The method of embodiment 238, wherein at least one of the first, the second, and the third recombination sites is selected from the group consisting of FRT1 (SEQ ID NO: 576), FRT 5 (SEQ ID NO: 577), FRT6 (SEQ ID NO: 579), FRT12 (SEQ ID NO: 579) and FRT87 (SEQ ID NO: 580).

240. The method of embodiment 230, wherein the Cas endonuclease is a Cas9 endonuclease or derived from a cas9 endonuclease.

241. The method of embodiment 230, wherein said plant cell is from a monocot or a dicot plant.

242. A plant generated from the plant cell of embodiment 230.

243. A method of integrating a polynucleotide of interest into a transgenic target site in the genome of a plant cell, the method comprising:

(a) providing at least one plant cell comprising in its genome a transgenic target site for site-specific integration, wherein the transgenic target site is integrated into an endogenous target site for a Cas endonuclease, and wherein the transgenic target site is, (i) a target site comprising a first and a second recombination site; or (ii) the target site of (i) further comprising a third recombination site between the first recombination site and the second recombination site, wherein the Cas endonuclease is capable of inducing a double-strand break in the endogenous target site, wherein the first, the second, and the third recombination sites are dissimilar with respect to one another, (b) introducing into the plant cell of (a) a transfer cassette comprising, (iii) the first recombination site, a first polynucleotide of interest, and the second recombination site, (iv) the second recombination site, a second polynucleotide of interest, and the third recombination sites, or (v) the first recombination site, a third polynucleotide of interest, and the third recombination sites;

(c) providing a recombinase that recognizes and implements recombination at the first and the second recombination sites, at the second and the third recombination sites, or at the first and third recombination sites; and (d) selecting at least one plant cell comprising integration of the transfer cassette at the target site.

244. A nucleic acid molecule comprising an RNA sequence selected from the group of SEQ ID NOs: 267-307, 441-480, and any one combination thereof.

245. A method of producing a complex trait locus in the genome of a plant comprising:

(a) providing a first plant having within a genomic window at least a first transgenic target site for site specific integration integrated into a first Cas9 endonuclease target site, and wherein said genomic window is about 10 cM in length and said first plant does not comprise a first genomic locus of interest;

(b) breeding to said first plant a second plant, wherein said second plant comprises in said genomic window the first genomic locus of interest and said second plant does not comprise said first transgenic target site; and, (c) selecting a progeny plant from step (b) comprising said first transgenic target site and said genomic locus of interest; wherein said first transgenic target site and said first genomic locus of interest have different genomic insertion site in said progeny plant.

246. A method of producing a complex trait locus in the genome of a plant comprising:

(a) providing a first plant having within a genomic window at least a first transgenic target site for site specific integration integrated into a first Cas9 endonuclease target site and a second transgenic target site for site specific integration integrated into a second Cas9 endonuclease target site, wherein said genomic window is about 10 cM in length, and wherein said first transgenic target site and said second transgenic target site have a different genomic insertion site, wherein said first plant does not comprise a first genomic locus of interest;

(b) breeding to said first plant a second plant, wherein said second plant comprises in said genomic window the first genomic locus of interest, wherein said second plant does not comprise said first transgenic target site or said second transgenic target site in the genomic window; and, (c) selecting a progeny plant from step (b) comprising said first transgenic target site, said second transgenic target site and said first genomic locus of interest;

wherein each of said first transgenic target site, said second transgenic target site and said first genomic locus of interest have a different genomic insertion site in said progeny plant.

247. The method of embodiment 246, wherein said genomic window is about 5 cM in length and wherein each of said first transgenic target site, said second transgenic target site, and said genomic locus of interest in said progeny plant segregate independently from one another at a rate of about 5% to 0.1%.

248. The method of embodiment 246, wherein said method further comprises
(a) breeding to said progeny plant a third plant comprising a second genomic locus of interest, wherein said third plant comprises in said genomic window said second genomic locus of interest, wherein said third plant does not comprise said first transgenic target site, said second transgenic target site or said first genomic locus of interest in said genomic window; and,
(b) selecting a second progeny plant from step (a) comprising said first transgenic target site, said second transgenic target site, said first genomic locus of interest, and said second genomic locus of interest;
wherein each of said first transgenic target site, said second transgenic target site, said first genomic locus of interest and said second genomic locus of interest have a different genomic insertion site in said second progeny plant; and,
wherein each of said first transgenic target site, said second transgenic target site, said first genomic locus of interest, or said second genomic locus of interest in said second progeny plant segregate independently from one another at a rate of about 10% to about 0.1%.

249. A method of producing a complex trait locus in the genome of a plant comprising
(a) providing a first plant having within a genomic window at least a first transgenic target site for site specific integration integrated into a first Cas9 endonuclease target site, wherein said first plant does not comprise a first genomic locus of interest, and wherein said genomic window:
(i) is flanked by at least a first marker comprising SYN12545, SYN12536, SYN14645, PZE-101023852, PZE-101024424, SYN25022, SYN31156, SYN31166 or SYN22238 and at least a second marker comprising SYN12536, SYN14645, PZE-101023852, PZE-101024424, SYN25022, SYN31156, SYN31166, SYN22238 or SYN20196; or,
(ii) is flanked by at least a first marker comprising PZE-101205031, PUT-163A-148951459-517, PZE-101205904 or PZE-101206569 and at least a second marker comprising PUT-163A-148951459-517, PZE-101205904, PZE-101206569 or SYN24492; or,
(iii) is flanked by at least a first marker comprising PZE-103000166, PZE-103000238, PZE-103000307 or SYN6355 and at least a second marker comprising PZE-103000238, PZE-103000307, SYN6355 or PZE-103001421; or,
(iv) is flanked by at least at least a first marker comprising PZE-110099037, PZE-110099048, PZE-110100195 or PZE-110100685 and at least a second marker comprising PZE-110099048, PZE-110100195, PZE-110100685 or PZE-110101412.
(b) breeding to said first plant a second plant, wherein said second plant comprises in said genomic window the first genomic locus of interest and said second plant does not comprise said first transgenic target site; and,
(c) selecting a progeny plant from step (b) comprising said first transgenic target site and said genomic locus of interest; wherein said first transgenic target site and said first genomic locus of interest have different genomic insertion sites in said progeny plant.

250. A method of altering a complex trait locus in the genome of a plant comprising
(a) providing a first plant having within a genomic window at least a first transgenic target site for site specific integration integrated into a first Cas9 endonuclease target site, a second transgenic target site for site specific integration integrated into a first Cas9 endonuclease target site, and a first genomic locus of interest, wherein said genomic window is about 10 cM in length, and wherein said first transgenic target site, said second transgenic target site, said first genomic locus of interest have a different genomic insertion site;
wherein each of said first transgenic target site, said second transgenic target site, or said first genomic locus of interest in said first plant segregate independently from one another at a rate of about 10% to about 0.1%;
(b) breeding to said first plant a second plant; and,
(c) selecting a progeny plant from step (b), wherein said genomic window from said progeny plant does not comprise any one of or any two of said first transgenic target site, said second transgenic target site, or said first genomic locus of interest.

251. A soybean plant, soybean plant part or soybean seed having in its genome a genomic window comprising at least one transgenic target site for site specific integration integrated into at least one double-strand-break target site, wherein said at least one transgenic target site is genetically linked to at least a first genetic marker and a second genetic marker, wherein said first genetic marker is selected from the group consisting of BARC_1.01_Gm01_6984873_T_C, BARC_1.01_Gm01_7775299_G_A, BARC_1.01_Gm01_7856395_A_C, BARC_1.01_Gm01_8569887_A_G, BARC_1.01_Gm01_8601858_C_T, BARC_1.01_Gm01_8641430_C_T, BARC_1.01_Gm01_8674202_A_C, BARC_1.01_Gm01_8933345_C_T, BARC_1.01_Gm01_8964201_T_C, BARC_1.01_Gm01_9014216_T_G, BARC_1.01_Gm01_28179606_A_G, BARC_1.01_Gm01_28364595_A_G, BARC_1.01_Gm01_28536363_G_A, BARC_1.01_Gm01_28599526_G_A, BARC_1.01_Gm01_28913996_A_G, BARC_1.01_Gm01_29284158_A_G, BARC_1.01_Gm01_31202345_C_T, BARC_1.01_Gm01_31770743_C_T, BARC_1.01_Gm01_32683433_G_A, or BARC_1.01_Gm01_34327255_C_T; and said second genetic marker is selected from the group consisting of BARC_1.01_Gm01_7775299_G_A, BARC_1.01_Gm01_7856395_A_C, BARC_1.01_Gm01_8569887_A_G, BARC_1.01_Gm01_8601858_C_T, BARC_1.01_Gm01_8641430_C_T, BARC_1.01_Gm01_8674202_A_C, BARC_1.01_Gm01_8933345_C_T, BARC_1.01_Gm01_8964201_T_C, BARC_1.01_Gm01_9014216_T_G, BARC_1.01_Gm01_28179606_A_G, BARC_0.01_Gm01_28364595_A_G, BARC_1.01_Gm01_28536363_G_A, BARC_0.01_Gm01_28599526_G_A, BARC_1.01_Gm01_28913996_A_G, BARC_0.01_Gm01_29284158_A_G, BARC_1.01_Gm01_31202345_C_T, BARC_0.01_Gm01_31770743_C_T,
BARC_1.01_Gm01_32683433_G_A,
BARC_0.01_Gm01_34327255_C_T, or
BARC_1.01_Gm01_36994849_A_G.

252. A soybean plant, soybean plant part or soybean seed having in its genome a genomic window comprising at least one transgenic target site for site specific integration integrated into at least one double-strand-break target site, wherein said at least one transgenic target site is genetically linked to at least a first genetic marker and a second genetic marker, wherein said first genetic marker is located between Gm01:6984873 and Gm01:34327255 on the soybean physical map, wherein said second genetic marker is located between Gm01:7775299 and Gm01:36994849 on the soybean physical map.

253. A soybean plant, soybean plant part or soybean seed having in its genome a genomic window comprising a transgene and at least one double-strand-break target site genetically linked to at least a first genetic marker and a second genetic marker, wherein said first genetic marker is selected from the group consisting of
BARC_1.01_Gm01_6984873_T_C,
BARC_1.01_Gm01_7775299_G_A,
BARC_1.01_Gm01_7856395_A_C,
BARC_1.01_Gm01_8569887_A_G,
BARC_1.01_Gm01_8601858_C_T,
BARC_1.01_Gm01_8641430_C_T,
BARC_1.01_Gm01_8674202_A_C,
BARC_1.01_Gm01_8933345_C_T,
BARC_1.01_Gm01_8964201_T_C,
BARC_1.01_Gm01_9014216_T_G,
BARC_1.01_Gm01_28179606_A_G,
BARC_1.01_Gm01_28364595_A_G,
BARC_1.01_Gm01_28536363_G_A,
BARC_1.01_Gm01_28599526_G_A,
BARC_1.01_Gm01_28913996_A_G,
BARC_1.01_Gm01_29284158_A_G,
BARC_1.01_Gm01_31202345_C_T,
BARC_1.01_Gm01_31770743_C_T,
BARC_1.01_Gm01_32683433_G_A, or
BARC_1.01_Gm01_34327255_C_T; and said second genetic marker is selected from the group consisting of
BARC_1.01_Gm01_7775299_G_A,
BARC_1.01_Gm01_7856395_A_C,
BARC_1.01_Gm01_8569887_A_G,
BARC_1.01_Gm01_8601858_C_T,
BARC_1.01_Gm01_8641430_C_T,
BARC_1.01_Gm01_8674202_A_C,
BARC_1.01_Gm01_8933345_C_T,
BARC_1.01_Gm01_8964201_T_C,
BARC_1.01_Gm01_9014216_T_G,
BARC_1.01_Gm01_28179606_A_G,
BARC_1.01_Gm01_28364595_A_G,
BARC_1.01_Gm01_28536363_G_A,
BARC_0.01_Gm01_28599526_G_A,
BARC_1.01_Gm01_28913996_A_G,
BARC_1.01_Gm01_29284158_A_G,
BARC_1.01_Gm01_31202345_C_T,
BARC_0.01_Gm01_31770743_C_T,
BARC_1.01_Gm01_32683433_G_A,
BARC_0.01_Gm01_34327255_C_T, or
BARC_1.01_Gm01_36994849_A_G.

254. A soybean plant, soybean plant part or soybean seed having in its genome a genomic window comprising a transgene and at least one transgenic target site for site specific integration integrated into at least one double-strand-break target site, wherein said at least one transgenic target site is genetically linked to at least a first genetic marker and a second genetic marker, wherein said first genetic marker is located between Gm01:6984873 and Gm01:34327255 on the soybean physical map, wherein said second genetic marker is located between Gm01:7775299 and Gm01:36994849 on the soybean physical map.

255. A soybean plant, soybean plant part or soybean seed having in its genome a genomic window comprising at least one transgenic target site for site specific integration integrated into at least one double-strand-break target site, wherein said at least one transgenic target site is genetically linked to at least a first genetic marker and a second genetic marker, wherein said first genetic marker is selected from the group consisting of
BARC_1.01_Gm06_46915875_T_C,
BARC_1.01_Gm06_47524452_G_T,
BARC_1.01_Gm06_47561262_C_T,
BARC_1.01_Gm06_47625670_C_T,
BARC_1.01_Gm06_47631544_T_C,
BARC_1.01_Gm06_47789229_C_T,
BARC_1.01_Gm06_47821576_T_G,
BARC_1.01_Gm06_47829363_A_C,
BARC_1.01_Gm06_47833095_A_G,
BARC_1.01_Gm06_47847021_G_T,
BARC_1.01_Gm06_47895876_G_A, or
BARC_1.01_Gm06_48221293_T_C and said second genetic marker is selected from the group consisting of
BARC_1.01_Gm06_47524452_G_T,
BARC_1.01_Gm06_47561262_C_T,
BARC_1.01_Gm06_47625670_C_T,
BARC_1.01_Gm06_47631544_T_C,
BARC_1.01_Gm06_47789229_C_T,
BARC_1.01_Gm06_47821576_T_G,
BARC_1.01_Gm06_47829363_A_C,
BARC_1.01_Gm06_47833095_A_G,
BARC_1.01_Gm06_47847021_G_T,
BARC_1.01_Gm06_47895876_G_A,
BARC_1.01_Gm06_48221293_T_C, or
BARC_1.01_Gm06_48528885_G_T.

256. A soybean plant, soybean plant part or soybean seed having in its genome a genomic window comprising at least one transgenic target site for site specific integration integrated into at least one double-strand-break target site, wherein said at least one transgenic target site is genetically linked to at least a first genetic marker and a second genetic marker, wherein said first genetic marker is located between Gm06:46915875 and Gm06:48221293 on the soybean physical map, wherein said second genetic marker is located between Gm06:47524452 and Gm06:48528885 on the soybean physical map.

257. A soybean plant, soybean plant part or soybean seed having in its genome a genomic window comprising a transgene and at least one double-strand-break target site genetically linked to at least a first genetic marker and a second genetic marker, wherein said first genetic marker is selected from the group consisting of
BARC_1.01_Gm06_46915875_T_C,
BARC_1.01_Gm06_47524452_G_T,
BARC_1.01_Gm06_47561262_C_T,
BARC_1.01_Gm06_47625670_C_T,
BARC_1.01_Gm06_47631544_T_C,
BARC_1.01_Gm06_47789229_C_T,
BARC_1.01_Gm06_47821576_T_G,
BARC_1.01_Gm06_47829363_A_C,
BARC_1.01_Gm06_47833095_A_G,
BARC_1.01_Gm06_47847021_G_T, BARC_1.01_Gm06_47895876_G_A, or BARC_1.01_Gm06_48221293_T_C and said second genetic marker is selected from the group consisting of BARC_1.01_Gm06_47524452_G_T, BARC_1.01_Gm06_47561262_C_T, BARC_1.01_Gm06_47625670_C_T, BARC_1.01_Gm06_47631544_T_C, BARC_1.01_Gm06_47789229_C_T, BARC_1.01_Gm06_47821576_T_G, BARC_1.01_Gm06_47829363_A_C, BARC_1.01_Gm06_47833095_A_G, BARC_1.01_Gm06_47847021_G_T, BARC_1.01_Gm06_47895876_G_A, BARC_1.01_Gm06_48221293_T_C, or BARC_1.01_Gm06_48528885_G_T.

258. A soybean plant, soybean plant part or soybean seed having in its genome a genomic window comprising a transgene and at least one transgenic target site for site specific integration integrated into at least one double-strand-break target site, wherein said at least one transgenic target site is genetically linked to at least a first genetic marker and a second genetic marker, wherein said first genetic marker is located between Gm06:46915875 and Gm06:48221293 on the soybean physical map, wherein said second genetic marker is located between Gm06:47524452 and Gm06:48528885 on the soybean physical map.

259. A soybean plant, soybean plant part or soybean seed having in its genome a genomic window comprising at least one transgenic target site for site specific integration integrated into at least one double-strand-break target site, wherein said at least one transgenic target site is genetically linked to at least a first genetic marker and a second genetic marker, wherein said first genetic marker is selected from the group consisting of BARC_1.01_Gm04_45591011_C_T, BARC_1.01_Gm04_45613405_T_C, BARC_1.01_Gm04_45697256_G_A, BARC_1.01_Gm04_45739051_A_C, BARC_1.01_Gm04_45800267_T_C, BARC_1.01_Gm04_45857325_T_C, BARC_1.01_Gm04_45857325_T_C, BARC_1.01_Gm04_45883080_A_G, BARC_1.01_Gm04_45903617_T_C, or BARC_1.01_Gm04_46000185_C_A and said second genetic marker is selected from the group consisting of BARC_1.01_Gm04_45613405_T_C, BARC_1.01_Gm04_45697256_G_A, BARC_1.01_Gm04_45739051_A_C, BARC_1.01_Gm04_45800267_T_C, BARC_1.01_Gm04_45857325_T_C, BARC_1.01_Gm04_45857325_T_C, BARC_1.01_Gm04_45883080_A_G, BARC_1.01_Gm04_45903617_T_C, BARC_1.01_Gm04_46000185_C_A, or BARC_1.01_Gm04_46113406_T_G.

260. A soybean plant, soybean plant part or soybean seed having in its genome a genomic window comprising at least one transgenic target site for site specific integration integrated into at least one double-strand-break target site, wherein said at least one transgenic target site is genetically linked to at least a first genetic marker and a second genetic marker, wherein said first genetic marker is located between Gm04:45591011 and Gm04:46000185 on the soybean physical map, wherein said second genetic marker is located between Gm04:45593558 and Gm04:46113406 on the soybean physical map.

261. A soybean plant, soybean plant part or soybean seed having in its genome a genomic window comprising a transgene and at least one double-strand-break target site genetically linked to at least a first genetic marker and a second genetic marker, wherein said first genetic marker is selected from the group consisting of BARC_1.01_Gm04_45591011_C_T, BARC_1.01_Gm04_45613405_T_C, BARC_1.01_Gm04_45697256_G_A, BARC_1.01_Gm04_45739051_A_C, BARC_1.01_Gm04_45800267_T_C, BARC_1.01_Gm04_45857325_T_C, BARC_1.01_Gm04_45857325_T_C, BARC_1.01_Gm04_45883080_A_G, BARC_1.01_Gm04_45903617_T_C, or BARC_1.01_Gm04_46000185_C_A and said second genetic marker is selected from the group consisting of BARC_1.01_Gm04_45613405_T_C, BARC_1.01_Gm04_45697256_G_A, BARC_1.01_Gm04_45739051_A_C, BARC_1.01_Gm04_45800267_T_C, BARC_1.01_Gm04_45857325_T_C, BARC_1.01_Gm04_45857325_T_C, BARC_1.01_Gm04_45883080_A_G, BARC_1.01_Gm04_45903617_T_C, BARC_1.01_Gm04_46000185_C_A, or BARC_1.01_Gm04_46113406_T_G.

262. A soybean plant, soybean plant part or soybean seed having in its genome a genomic window comprising a transgene and at least one transgenic target site for site specific integration integrated into at least one double-strand-break target site, wherein said at least one transgenic target site is genetically linked to at least a first genetic marker and a second genetic marker, wherein said first genetic marker is located between Gm04:45591011 and Gm04:46000185 on the soybean physical map, wherein said second genetic marker is located between Gm04:45593558 and Gm04:46113406 on the soybean physical map.

263. A maize plant, maize plant part or maize seed having in its genome a genomic window comprising at least one transgenic target site for site specific integration integrated into at least one double-strand-break target site, wherein said at least one transgenic target site is genetically linked to at least a first genetic marker and a second genetic marker, wherein said first genetic marker is selected from the group consisting of SYN12545, SYN12536, SYN14645, PZE-101023852, PZE-101024424, SYN25022, SYN31156, SYN31166 or SYN22238 and said second genetic marker is selected from the group consisting of SYN12536, SYN14645, PZE-101023852, PZE-101024424, SYN25022, SYN31156, SYN31166, SYN22238 or SYN20196.

264. A maize plant, maize plant part or maize seed having in its genome a genomic window comprising at least one transgenic target site for site specific integration integrated into at least one double-strand-break target site, wherein said at least one transgenic target site is genetically linked to at least a first genetic marker and a second genetic marker, wherein said first genetic marker is located between position 12987435 and 15491134 on the maize PUB-B73v3 physical map, wherein said second genetic marker is located between position 12988556 and 15512479 on the maize PUB-B73v3 physical map 265. A maize plant, maize plant part or maize seed having in its genome a genomic window comprising a transgene and at least one double-strand-break target site genetically linked to at least a first genetic marker and a second genetic marker, wherein said first genetic marker is selected from the group consisting of SYN12545, SYN12536, SYN14645, PZE-101023852, PZE-101024424, SYN25022, SYN31156, SYN31166 or SYN22238 and said second genetic marker is selected from the group consisting of SYN12536, SYN14645, PZE-101023852, PZE-101024424, SYN25022, SYN31156, SYN31166, SYN22238 or SYN20196.

266. A maize plant, maize plant part or maize seed having in its genome a genomic window comprising a transgene and at least one transgenic target site for site specific integration integrated into at least one double-strand-break target site, wherein said at least one transgenic target site is genetically linked to at least a first genetic marker and a second genetic marker, wherein said first genetic marker is located between position 12987435 and 15491134 on the maize PUB-B73v3 physical map, wherein said second genetic marker is located between position 12988556 and 15512479 on the maize PUB-B73v3 physical map 267. A maize plant, maize plant part or maize seed having in its genome a genomic window comprising at least one transgenic target site for site specific integration integrated into at least one double-strand-break target site, wherein said at least one transgenic target site is genetically linked to at least a first genetic marker and a second genetic marker, wherein said first genetic marker is selected from the group consisting of PZE-101205031, PUT-163A-148951459-517, PZE-101205904 or PZE-101206569 and said second genetic marker is selected from the group consisting of PUT-163A-148951459-517, PZE-101205904, PZE-101206569 or SYN24492.

268. A maize plant, maize plant part or maize seed having in its genome a genomic window comprising at least one transgenic target site for site specific integration integrated into at least one double-strand-break target site, wherein said at least one transgenic target site is genetically linked to at least a first genetic marker and a second genetic marker, wherein said first genetic marker is located between position 253779529 and 255783594 on the maize PUB-B73v3 physical map, wherein said second genetic marker is located between position 253823089 and 256998852 on the maize PUB-B73v3 physical map.

269. A maize plant, maize plant part or maize seed having in its genome a genomic window comprising a transgene and at least one double-strand-break target site genetically linked to at least a first genetic marker and a second genetic marker, wherein said first genetic marker is selected from the group consisting of PZE-101205031, PUT-163A-148951459-517, PZE-101205904 or PZE-101206569 and said second genetic marker is selected from the group consisting PUT-163A-148951459-517, PZE-101205904, PZE-101206569 or SYN24492.

270. A maize plant, maize plant part or maize seed having in its genome a genomic window comprising a transgene and at least one transgenic target site for site specific integration integrated into at least one double-strand-break target site, wherein said at least one transgenic target site is genetically linked to at least a first genetic marker and a second genetic marker, wherein said first genetic marker is located between position 253779529 and 255783594 on the maize PUB-B73v3 physical map, wherein said second genetic marker is located between position 253823089 and 256998852 on the maize PUB-B73v3 physical map.

271. A maize plant, maize plant part or maize seed having in its genome a genomic window comprising at least one transgenic target site for site specific integration integrated into at least one double-strand-break target site, wherein said at least one transgenic target site is genetically linked to at least a first genetic marker and a second genetic marker, wherein said first genetic marker is selected from the group consisting of PZE-103000166, PZE-103000238, PZE-103000307 or SYN6355 and said second genetic marker is selected from the group consisting of PZE-103000238, PZE-103000307, SYN6355 or PZE-103001421.

272. A maize plant, maize plant part or maize seed having in its genome a genomic window comprising at least one transgenic target site for site specific integration integrated into at least one double-strand-break target site, wherein said at least one transgenic target site is genetically linked to at least a first genetic marker and a second genetic marker, wherein said first genetic marker is located between position 742991 and 1577833 on the maize PUB-B73v3 physical map, wherein said second genetic marker is located between position 899135 and 1614189 on the maize PUB-B73v3 physical map 273. A maize plant, maize plant part or maize seed having in its genome a genomic window comprising a transgene and at least one double-strand-break target site genetically linked to at least a first genetic marker and a second genetic marker, wherein said first genetic marker is selected from the group consisting of comprising PZE-103000166, PZE-103000238, PZE-103000307 or SYN6355 and said second genetic marker is selected from the group consisting PZE-103000238, PZE-103000307, SYN6355 or PZE-103001421.

274. A maize plant, maize plant part or maize seed having in its genome a genomic window comprising a transgene and at least one transgenic target site for site specific integration integrated into at least one double-strand-break target site, wherein said at least one transgenic target site is genetically linked to at least a first genetic marker and a second genetic marker, wherein said first genetic marker is located between position 742991 and 1577833 on the maize PUB-B73v3 physical map, wherein said second genetic marker is located between position 899135 and 1614189 on the maize PUB-B73v3 physical map.

275. A maize plant, maize plant part or maize seed having in its genome a genomic window comprising at least one transgenic target site for site specific integration integrated into at least one double-strand-break target site, wherein said at least one transgenic target site is genetically linked to at least a first genetic marker and a second genetic marker, wherein said first genetic marker is selected from the group consisting of PZE-110099037, PZE-110099048, PZE-110100195 or PZE-110100685 and said second genetic marker is selected from the group consisting of PZE-110099110099048, PZE-110100195, PZE-110100685 or PZE-110101412.

276. A maize plant, maize plant part or maize seed having in its genome a genomic window comprising at least one transgenic target site for site specific integration integrated into at least one double-strand-break target site, wherein said at least one transgenic target site is genetically linked to at least a first genetic marker and a second genetic marker, wherein said first genetic marker is located between position 143748355 and 144438619 on the maize PUB-B73v3 physical map, wherein said second genetic marker is located between position 143749018 and 144620418 on the maize PUB-B73v3 physical map.

277. A maize plant, maize plant part or maize seed having in its genome a genomic window comprising a transgene and at least one double-strand-break target site genetically linked to at least a first genetic marker and a second genetic marker, wherein said first genetic marker is selected from the group consisting of PZE-110099037, PZE-110099048, PZE-110100195 or PZE-110100685 and said second genetic marker is selected from the group comprising PZE-110099048, PZE-110100195, PZE-110100685 or PZE-110101412.

278. A maize plant, maize plant part or maize seed having in its genome a genomic window comprising a transgene and at least one transgenic target site for site specific integration integrated into at least one double-strand-break target site, wherein said at least one transgenic target site is genetically linked to at least a first genetic marker and a second genetic marker, wherein said first genetic marker is located between position 143748355 and 144438619 on the maize PUB-B73v3 physical map, wherein said second genetic marker is located between position 143749018 and 144620418 on the maize PUB-B73v3 physical map.

EXAMPLES

In the following Examples, unless otherwise stated, parts and percentages are by weight and degrees are Celsius. It should be understood that these Examples, while indicating embodiments of the disclosure, are given by way of illustration only. From the above discussion and these Examples, one skilled in the art can make various changes and modifications of the disclosure to adapt it to various usages and conditions. Such modifications are also intended to fall within the scope of the appended claims.

Example 1

DNA Constructs for Guide RNA/Cas Endonuclease Systems for Maize Genome Modifications To test the guide RNA/Cas endonuclease system in maize, the Cas9 gene from *Streptococcus pyogenes* M1 GAS (SF370) (SEQ ID NO: 308) was maize codon optimized per standard techniques known in the art and the potato ST-LS1 intron was introduced in order to eliminate its expression in *E. coli* and *Agrobacterium*. To facilitate nuclear localization of the Cas9 protein in maize cells, Simian virus 40 (SV40) monopartite amino terminal nuclear localization signal (MAPKKKRKV, SEQ ID NO: 309) and *Agrobacterium tumefaciens* bipartite VirD2 T-DNA border endonuclease carboxyl terminal nuclear localization signal (KRPRDRHDGELGGRKRAR, SEQ ID NO: 310) were incorporated at the amino and carboxyl-termini of the Cas9 open reading frame respectively. The maize optimized Cas9 gene was operably linked to a maize Ubiquitin promoter by standard molecular biological techniques. A maize optimized Cas9 expression cassette is listed in SEQ ID NO: 311.

The maize U6 polymerase III promoter (SEQ ID NO: 312) was used to express guide RNAs which direct Cas9 nuclease to designated genomic sites (as described in U.S. patent application Ser. No. 14/463,687 filed on Aug. 20, 2014 incorporated by reference herein). The guide RNA coding sequence was 77 bp long and comprised a 12-30 bp variable targeting domain from a chosen maize genomic target site on the 5' end maize U6 polymerase III terminator (as described in U.S. patent application Ser. No. 14/463,687 filed on Aug. 20, 2014).

To improve the co-expression and presence of the Cas9 endonuclease and the guide RNA to form a protein/RNA complex, the Cas9 endonuclease and guide RNA expression cassettes were linked into a single DNA construct. A 450-470 bp sequence containing the guide RNA coding sequence comprising the 12-30 bp variable targeting domain from the chosen maize genomic target site, and part of the U6 promoter were synthesized (Integrated DNA Technologies, Inc. 1710 Commercial Park, Coralville, Iowa 52241, USA). The sequence was then cloned to the backbone already having the Cas9 expression cassette and the rest of the U6 promoter (for example bp 6741-7405 from SEQ ID NO: 106) of the gRNA expression cassette through restrict sites of BstBI/HindIII, which was then used to transform maize cells to test the maize optimized guide RNA/Cas system for genome modification. Similar DNA constructs were made to target different genomic sites using guide RNAs containing different target sequences as described in Example 3.

Example 2

Selection of Maize Genomic Windows for the Introduction of Site Specific Integration (SSI) Transgenic Target Sites by the Guide RNA/Cas Endonuclease System and Complex Trait Loci Development Four maize genomic regions (also referred to as genomic windows, FIG. 1) were identified for the production of Complex Trait Loci comprising a combination of transgenic target sites for SSI introduced into that genomic window by a maize optimized guide RNA/Cas9 endonuclease system described herein (FIG. 2A-2D).

The first maize genomic window that was identified for development of a Complex Trait Locus (CTL) spans from ZM01: 12987435 (flanked by public SNP marker SYN12545) to Zm01:15512479 (flanked by public SNP marker SYN20196) on chromosome 1 (FIG. 4). Table 1 shows the physical and genetic map position (if available) for a multitude of maize SNP markers (Ganal, M. et al, A Large Maize (*Zea mays* L.) SNP Genotyping Array: Development and Germplasm Genotyping, and Genetic Mapping to Compare with the B73 Reference Genome. PloS one, Dec. 8, 2011DOI: 10.1371) and Cas endonuclease target sites (31 sites) within the genomic window of interest on the maize chromosome 1.

TABLE 1

Genomic Window comprising a Complex Trait Locus (CTL1) on Chromosome 1 of maize

| Name of public SNP markers (*) or Cas endonuclease target site | Cas endonuclease target or SNP marker sequence (SEQ ID NO:) | Physical position (PUB B73v3) | Genetic Position (PUB B73v3) | Genetic Position (PHI) |
|---|---|---|---|---|
| SYN12545* | 1 | 12987435 | 36.9 | 50.35 |
| SYN12536* | 2 | 12988556 | 36.9 | 50.36 |
| 49-CR2 | 3 | 13488227 | | 50.87 |
| 50-CR1 | 4 | 13554078 | | 50.95 |
| 51-CR1 | 5 | 13676343 | | 51.06 |
| SYN14645* | 6 | 13685871 | 37.4 | 51.07 |
| 41-CR2 | 7 | 13830316 | | 51.27 |
| 72-CR1 | 8 | 13841735 | | 51.33 |

TABLE 1-continued

Genomic Window comprising a Complex Trait Locus (CTL1) on Chromosome 1 of maize

| Name of public SNP markers (*) or Cas endonuclease target site | Cas endo-nuclease target or SNP marker sequence (SEQ ID NO:) | Physical position (PUB B73v3) | Genetic Position (PUB B73v3) | Genetic Position (PHI) |
|---|---|---|---|---|
| 71-CR1 | 9 | 13846794 | | 51.32 |
| 81-CR1 | 10 | 13967499 | | 51.45 |
| 73-CR1 | 11 | 13986903 | | 51.48 |
| PZE-101023852* | 12 | 14030843 | 37.6 | 51.53 |
| 14-CR4 | 13 | 14038610 | | 51.54 |
| 74-CR1 | 14 | 14089937 | | 51.61 |
| 75-CR1 | 15 | 14226763 | | 51.68 |
| 84-CR1 | 16 | 14233410 | | 51.68 |
| 76-CR1 | 17 | 14245535 | | 51.69 |
| 77-CR1 | 18 | 14344614 | | 51.72 |
| 78-CR1 | 19 | 14380330 | | 51.75 |
| PZE-101024424* | 20 | 14506833 | 37.8 | 51.81 |
| 79-CR1 | 21 | 14577827 | | 51.84 |
| 85-CR1 | 22 | 14811592 | | 51.95 |
| 19-CR1 | 23 | 14816379 | | 51.95 |
| SYN25022* | 24 | 14851517 | 37.8 | 51.97 |
| 86-CR1 | 25 | 14951113 | | 52.54 |
| 08-CR1 | 26 | 14955364 | | 52.56 |
| 43-CR1 | 27 | 15006039 | | 52.8 |
| 11-CR1 | 28 | 15066942 | | 53.15 |
| SYN31156* | 29 | 15070918 | 39.9 | 53.16 |
| 47-CR2 | 30 | 15081190 | | 53.21 |
| 80-CR1 | 31 | 15084949 | | 53.23 |
| 52-CR2 | 32 | 15088711 | | 53.25 |
| 87-CR1 | 33 | 15158706 | | 53.57 |
| 88-CR1 | 34 | 15162366 | | 53.59 |
| SYN31166* | 35 | 15169575 | 40.9 | 53.62 |
| 45-CR1 | 36 | 15177228 | | 53.66 |
| 10-CR3 | 37 | 15274433 | | 54.56 |
| 44-CR2 | 38 | 15317833 | | 54.16 |
| 46-CR2 | 39 | 15345674 | | 54.43 |
| SYN22238* | 40 | 15491134 | 41.7 | 54.99 |
| SYN20196* | 41 | 15512479 | 41.9 | 55.48 |

Figure 5:
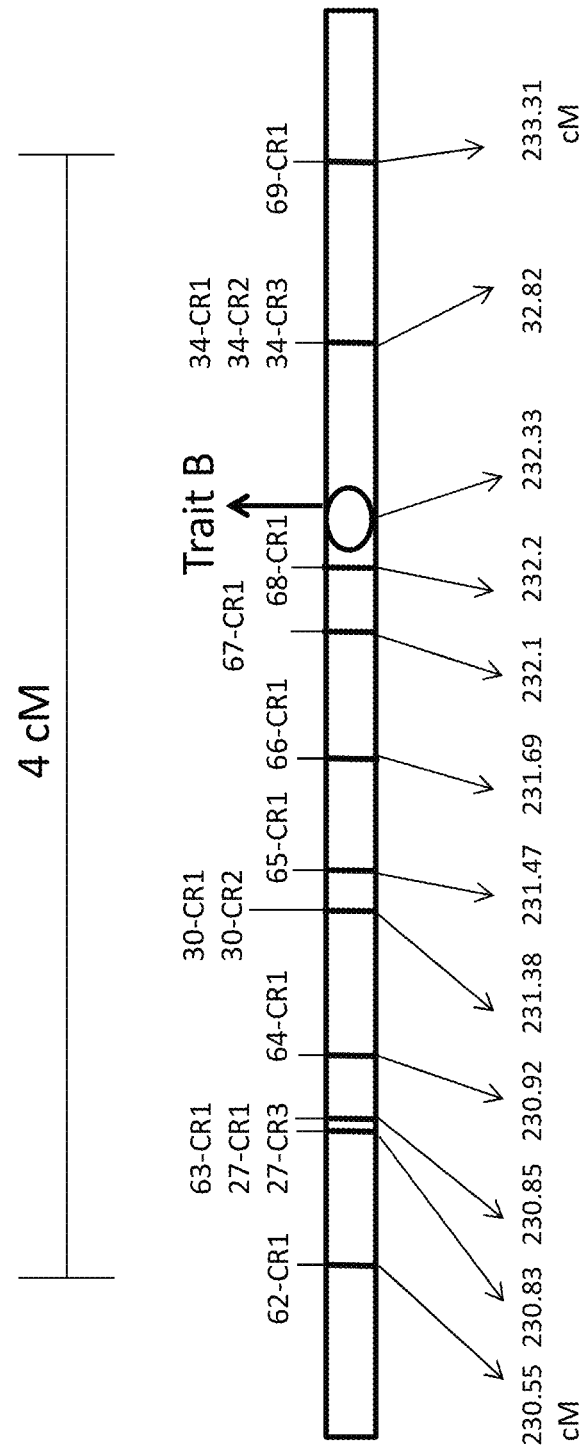
FIG. 5 shows a schematic of the maize genomic window (CTL2) on chromosome 1. The genomic window is about 4 cM in length and contains 15 Cas endonuclease target sites (listed above the bar diagram representing the genomic window, such as 62-CR1) located near trait B (represented by an oval). The genetic location (cM) of each of the Cas endonuclease target sites is shown below the bar diagram (for example target site 62-CR1 is located at 230.55 cM on chromosome 1).

The second maize genomic window that was identified for the development of a Complex Trait Locus (CTL) spans from Zm01:253.78 MM (flanked by public SNP marker PZE-101205031) to Zm01: 257 MM (flanked by public SNP marker SYN24492) on chromosome 1 (FIG. 5). Table 2 shows the physical and genetic map position (if available) for a multitude of maize SNP markers (Ganal, M. et al (2011) PloS one, DOI: 10.1371) and Cas endonuclease target sites (15 sites) within this genomic window of interest on the maize chromosome 1.

TABLE 2

Genomic Window comprising a Complex Trait Locus 2 (CTL2) on Chromosome 1 of maize

| Name of public SNP markers (*) or Cas endonuclease target site | Cas endo-nuclease target or SNP marker sequence (SEQ ID NO:) | Physical position (PUB B73v3) | Genetic Position (PUB B73v3) | Genetic Position (PHI) |
|---|---|---|---|---|
| PZE-101205031* | 42 | 253779529 | 185.7 | 230.5 |
| 62-CR1 | 43 | 253823089 | | 230.55 |
| 27-CR1 | 44 | 254009239 | | 230.83 |
| 27-CR3 | 45 | 254009251 | | 230.83 |
| 63-CR1 | 46 | 254022286 | | 230.85 |
| 64-CR1 | 47 | 254064681 | | 230.92 |
| PUT-163A-148951459-517* | 48 | 254154625 | — | 231.06 |
| 30-CR2 | 49 | 254323740 | | 231.38 |
| 30-CR1 | 50 | 254323749 | | 231.38 |
| 65-CR1 | 51 | 254362279 | | 231.47 |

TABLE 2-continued

Genomic Window comprising a Complex Trait Locus 2 (CTL2) on Chromosome 1 of maize

| Name of public SNP markers (*) or Cas endonuclease target site | Cas endo-nuclease target or SNP marker sequence (SEQ ID NO:) | Physical position (PUB B73v3) | Genetic Position (PUB B73v3) | Genetic Position (PHI) |
|---|---|---|---|---|
| 66-CR1 | 52 | 254528255 | | 231.69 |
| PZE-101205904* | 53 | 254809233 | — | 232.1 |
| 67-CR1 | 54 | 254810763 | | 232.1 |
| 68-CR1 | 55 | 254873093 | | 232.2 |
| 34-CR1 | 56 | 255390916 | | 232.82 |
| 34-CR3 | 57 | 255390924 | | 232.82 |
| 34-CR2 | 58 | 255390944 | | 232.82 |
| PZE-101206569* | 59 | 255763233 | — | 233.29 |
| 69-CR1 | 60 | 255783594 | | 233.31 |
| SYN24492* | 61 | 256998852 | 188.6 | 234.74 |

Figure 6:
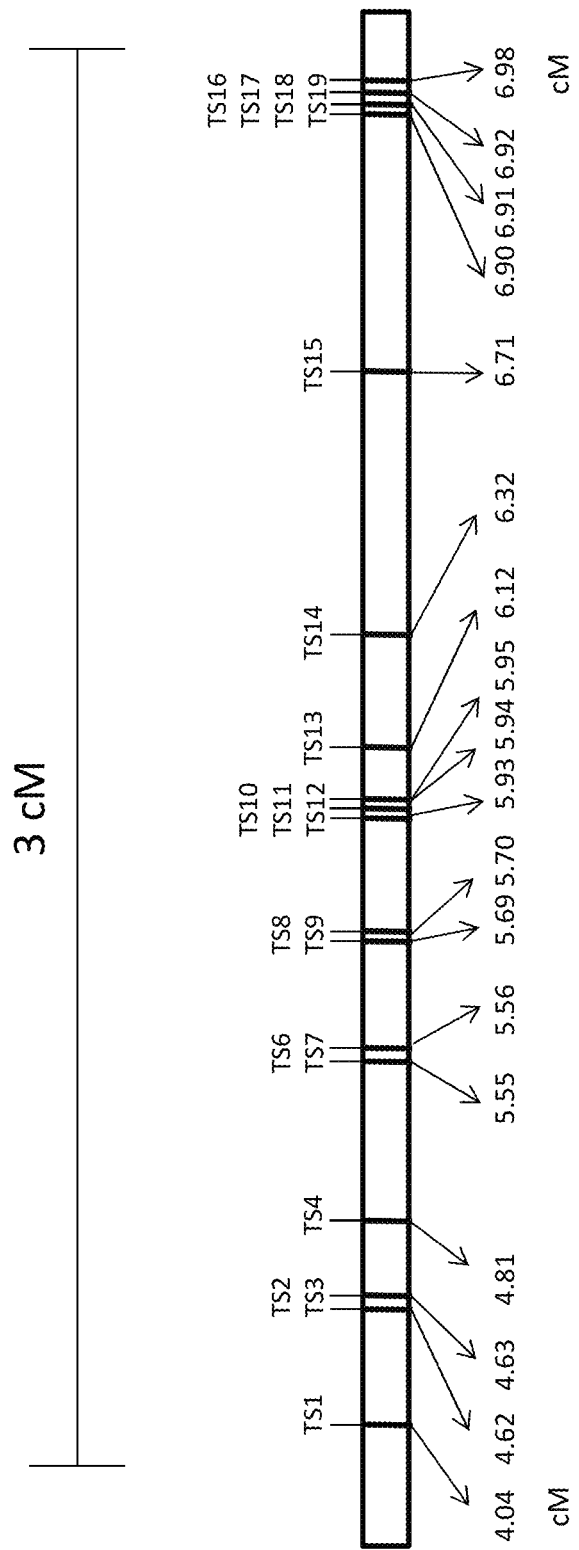
FIG. 6 shows a schematic of the maize genomic window (CTL3) on chromosome 3. The genomic window is about 3 cM in length and contains 15 Cas endonuclease target sites (listed above the bar diagram representing the genomic window, such as TS1). The genetic location (cM) of each of the Cas endonuclease target sites is shown below the bar diagram (for example target site TS1 is located at 4.04 cM on chromosome 3).

The third maize genomic window that was identified for the development of a Complex Trait Locus (CTL) spans from Zm03: 742991 (flanked by public SNP marker PZE-103000166) to Zm03: 1614189 (flanked by public SNP marker PZE-103001421) on chromosome 3 (FIG. 6). Table 3 shows the physical and genetic map position (if available) for a multitude of maize SNP markers (Ganal, M. et al (2011) PloS one, DOI: 10.1371) and Cas endonuclease target sites (18 sites) within this genomic window of interest on the maize chromosome 3.

TABLE 3

Genomic Window comprising a Complex Trait Locus 3 (CTL3) on Chromosome 3 of maize

| Name of public SNP markers (*) or Cas endonuclease target site | Cas endo-nuclease target or SNP marker sequence (SEQ ID NO:) | Physical position (PUB B73v3) | Genetic Position (PUB B73v3) | Genetic Position (PHI) |
|---|---|---|---|---|
| PZE-103000166* | 62 | 742991 | — | 3.44 |
| chr3-TS1 | 63 | 899135 | | 4.04 |
| chr-TS2 | 64 | 1036161 | | 4.62 |
| chr3-TS3 | 65 | 1037353 | | 4.63 |
| chr-TS4 | 66 | 1083686 | | 4.81 |
| PZE-103000238* | 67 | 1106831 | — | 4.91 |
| Chr3-TS6 | 68 | 1172164 | | 5.55 |
| Chr3-TS7 | 69 | 1218009 | | 5.56 |
| Chr3-TS10 | 70 | 1219548 | | 5.93 |
| Chr3-TS11 | 71 | 1223674 | | 5.94 |
| Chr3-TS12 | 72 | 1223862 | | 5.95 |
| PZE-103000307* | 73 | 1233863 | — | 5.62 |
| Chr3-TS9 | 74 | 1270677 | | 5.70 |
| Chr3-TS8 | 75 | 1272057 | | 5.69 |
| Chr3-TS13 | 76 | 1337819 | | 6.12 |
| Chr3-TS14 | 77 | 1386369 | | 6.32 |
| Chr3-TS15 | 78 | 1459144 | | 6.71 |
| SYN6355* | 79 | 1554858 | 0.4 | 6.88 |
| Chr3-TS16 | 80 | 1559776 | | 6.90 |
| Chr3-TS17 | 81 | 1561991 | | 6.91 |
| Chr3-TS18 | 82 | 1563993 | | 6.92 |
| Chr3-TS19 | 83 | 1577833 | | 6.98 |
| PZE-103001421* | 84 | 1614189 | | 7.22 |

Figure 7:
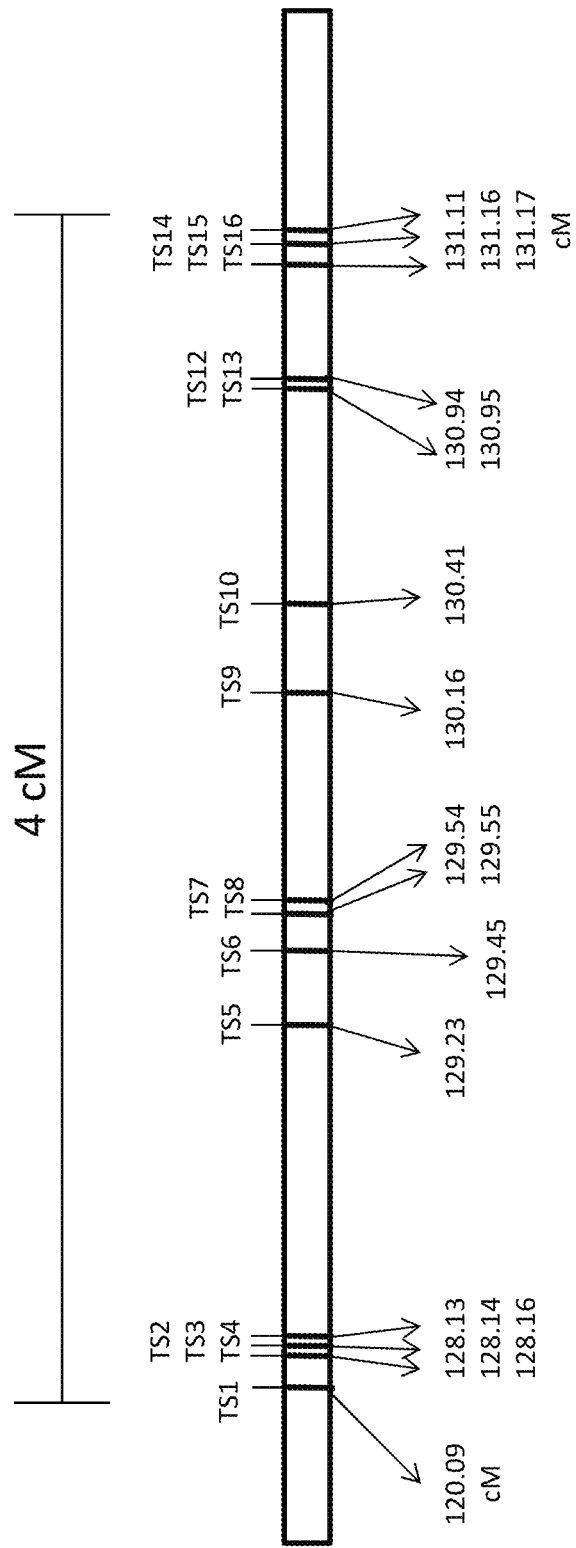
FIG. 7 shows a schematic of the maize genomic window (CTL4) on chromosome 10. The genomic window is about 4 cM in length and contains 15 Cas endonuclease target sites (listed above the bar diagram representing the genomic window, such as TS1). The genetic location (cM) of each of the Cas endonuclease target sites is shown below the bar diagram (for example target site TS1 is located at 120.09 cM on chromosome 10).

The fourth maize genomic window that was identified for the development of a Complex Trait Locus (CTL) spans from Zm10: 143.75 MM (flanked by public SNP marker PZE-110099037) to Zm10: 144.62 MM (flanked by public SNP marker PZE-110101412) on chromosome 10 (FIG. 7). Table 4 shows the physical and genetic map position (if available) for a multitude of maize SNP markers (Ganal, M. et al (2011) PloS one, DOI: 10.1371) and Cas endonuclease target sites (15 sites) within this genomic window of interest on the maize chromosome 10.

The internal and public genetic position are not all aligned to the same order for this region, this could due to the wrong assembly either the public or internal.

TABLE 4

Genomic Window comprising a Complex Trait Locus 4 (CTL4) on Chromosome 10 of maize

| Name of public SNP markers (*) or Cas endonuclease target site | Cas endonuclease target or SNP marker sequence (SEQ ID NO:) | Physical position (PUB B73v3) | Genetic Position (PUBB73v3) | Genetic Position (PHI B73v2) |
|---|---|---|---|---|
| PZE-110099037* | 85 | 143748355 | 93.5 | 128.26 |
| PZE-110099048* | 86 | 143749018 | — | 128.25 |
| chr10-TS4 | 87 | 143820705 | | 128.16 |
| chr10-TS3 | 88 | 143824753 | | 128.14 |
| chr10-TS2 | 89 | 143826830 | | 128.13 |
| chr10-TS1 | 90 | 143836660 | | 128.09 |
| SYN29534* | 91 | 144045172 | 94.6 | 129.11 |
| chr10-TS5 | 92 | 144087077 | | 129.23 |
| chr10-TS6 | 93 | 144174303 | | 129.45 |
| PZE-110100195* | 94 | 144177211 | 94.8 | 129.46 |
| chr10-TS7 | 95 | 144208739 | | 129.54 |
| chr10-TS8 | 96 | 144209967 | | 129.55 |
| chr10-TS10 | 97 | 144350690 | | 130.41 |
| chr10-TS9 | 98 | 144358655 | | 130.16 |
| PZE-110100685* | 99 | 144410276 | 96.6 | 131.79 |
| chr10-TS16 | 100 | 144416223 | | 131.17 |
| chr10-TS15 | 101 | 144417106 | | 131.16 |
| chr10-TS14 | 102 | 144421928 | | 131.11 |
| chr10-TS13 | 103 | 144438323 | | 130.95 |
| chr10-TS12 | 104 | 144438619 | | 130.94 |
| PZE-110101412* | 105 | 144620418 | 98.4 | 132.71 |

Example 3

Guide RNA Expression Cassettes, Cas9 Endonuclease Expression Cassettes and Donor DNA's for Introduction of Transgenic Target Sites for SSI in a Maize Genomic Window The maize U6 maize U6 polymerase III promoter (SEQ ID NO: 312) was used to express guide RNAs to direct Cas9 nuclease to designated genomic target sites. A maize codon optimized Cas9 endonuclease expression cassette and a guide RNA expression cassette were linked in a first plasmid that was co-delivered with a second plasmid comprising a donor DNA (repair DNA) cassette (FIG. 2C). The donor DNA contained FRT1/FRT87(6) recombination sites for site specific integration, flanking the NPTII marker: terminator (FIG. 2B) which upon integration by homologous recombination with the guide RNA/Cas system created the FRT1/FRT87(6) target lines for SSI technology application (FIG. 2D).

The guide RNA (gRNA)/Cas9 DNA constructs targeting various maize genomic sites that were constructed for the introduction of transgenic SSI target sites into Cas endonuclease target sites through homologous recombination are listed in Table 5 and Table 7. Table 6 and Table 8 list the guide RNAs that were expressed from the guide RNA constructs. The bases of the guide RNA that comprise the variable targeting domain are listed in the Tables 6 and 8 as well. For example, the first 19 bases of SEQ ID NO: 267 (base 1-19) comprise the variable targeting domain of guide RNA 49-CR2 (Table 6). All the guide RNA/Cas9 constructs differed only in the 17-25 bp guide RNA variable targeting domain targeting the maize genomic target sites. All the donor DNA constructs differed only in the homologous regions such as ZM-SEQX(HR1) and ZM-SEQY(HR2). These guide RNA/Cas9 DNA constructs and donor DNAs were co-delivered into an elite maize genome by the stable transformation procedure described in Example 4.

TABLE 5

Guide RNA/Cas9 used in maize Stable Transformation for the Complex Trait Locus on ZM01-CTL1

| Experiment | Guide RNA/Cas9 | SEQ ID NO. |
|---|---|---|
| 49-CR2 | ZM-U6:49CR2 + UBI:CAS9 (PHP70573) | 106 |
| 50-CR1 | ZM-U6:50CR1 + UBI:CAS9 (PHP70586) | 107 |
| 51-CR1 | ZM-U6:51CR1 + UBI:CAS9 (PHP70581) | 108 |
| 41-CR2 | ZM-U6:41CR2 + UBI:CAS9 (PHP70582) | 109 |
| 72-CR1 | ZM-U6:72CR1 + UBI:CAS9 (PHP70588) | 110 |
| 71-CR1 | ZM-U6:71CR1 + UBI:CAS9 (PHP70587) | 111 |
| 81-CR1 | ZM-U6:81CR1 + UBI:CAS9 (PHP70589) | 112 |
| 73-CR1 | ZM-U6:73CR1 + UBI:CAS9 (PHP70590) | 113 |
| 14-CR4 | ZM-U6:14CR4 + UBI:CAS9 (PHP70591) | 114 |
| 74-CR1 | ZM-U6:74CR1 + UBI:CAS9 (PHP70592) | 115 |
| 75-CR1 | ZM-U6:75CR1 + UBI:CAS9 (PHP70593) | 116 |
| 84-CR1 | ZM-U6:84CR1 + UBI:CAS9 (PHP70594) | 117 |
| 76-CR1 | ZM-U6:76CR1 + UBI:CAS9 (PHP70595) | 118 |
| 77-CR1 | ZM-U6:77CR1 + UBI:CAS9 (PHP70596) | 119 |
| 78-CR1 | ZM-U6:78CR1 + UBI:CAS9 (PHP70597) | 120 |
| 85-CR1 | ZM-U6:85CR1 + UBI:CAS9 (PHP70599) | 121 |
| 19-CR1 | ZM-U6I:19CR1 + UBI:CAS9 (PHP70577) | 122 |
| 86-CR1 | ZM-U6:86CR1 + UBI:CAS9 (PHP70600) | 123 |
| 8-CR1 | ZM-U6:8CR1 + UBI:CAS9 (PHP71193) | 124 |
| 43-CR1 | ZM-U6:43CR1 + UBI:CAS9 (PHP70583) | 125 |
| 11-CR1 | ZM-U6:11CR1 + UBI:CAS9 (PHP70584) | 126 |
| 47-CR2 | ZM-U6:47CR2 + UBI:CAS9 (PHP70574) | 127 |
| 80-CR1 | ZM-U6:80CR1 + UBI:CAS9 (PHP70601) | 128 |
| 52-CR2 | ZM-U6:52CR2 + UBI:CAS9 (PHP70602) | 129 |
| 87-CR1 | ZM-U6:87CR1 + UBI:CAS9 (PHP70603) | 130 |
| 88-CR1 | ZM-U6:88CR1 + UBI:CAS9 (PHP70604) | 131 |
| 45-CR1 | ZM-U6:45CR1 + UBI:CAS9 (PHP70605) | 132 |
| 10-CR3 | ZM-U6:10CR3 + UBI:CAS9 (PHP70580) | 133 |
| 44-CR2 | ZM-U6:44CR2 + UBI:CAS9 (PHP70575) | 134 |
| 46-CR2 | ZM-U6:46CR2 + UBI:CAS9 (PHP70585) | 135 |

TABLE 6

Guide RNA used in maize Stable Transformation for the Complex Trait Locus on ZM01-CTL1

| Guide RNA name | SEQ ID NO: | Variable targeting domains |
|---|---|---|
| 49-CR2 | 267 | Base 1-19 |
| 50--CR1 | 268 | Base 1-19 |
| 51-CR1 | 269 | Base 1-21 |
| 41-CR2 | 270 | Base 1-21 |
| 72-CR1 | 271 | Base 1-20 |
| 71-CR1 | 272 | Base 1-22 |
| 81-CR1 | 273 | Base 1-20 |
| 73-CR1 | 274 | Base 1-19 |
| 14-CR4 | 275 | Base 1-20 |
| 74-CR1 | 276 | Base 1-19 |
| 75-CR1 | 277 | Base 1-20 |
| 84-CR1 | 278 | Base 1-20 |
| 76-CR1 | 279 | Base 1-21 |
| 77-CR1 | 280 | Base 1-22 |
| 78-CR1 | 281 | Base 1-20 |
| 85-CR1 | 282 | Base 1-19 |
| 19-CR1 | 283 | Base 1-24 |
| 86-CR1 | 284 | Base 1-21 |
| 8-CR1 | 285 | Base 1-18 |
| 43-CR1 | 286 | Base 1-21 |
| 11-CR1 | 287 | Base 1-18 |
| 47-CR1 | 288 | Base 1-22 |
| 80-CR1 | 289 | Base 1-24 |
| 52-CR2 | 290 | Base 1-19 |
| 87-CR1 | 291 | Base 1-20 |
| 88-CR1 | 292 | Base 1-23 |
| 45-CR1 | 293 | Base 1-21 |
| 10-CR3 | 294 | Base 1-18 |
| 44-CR2 | 295 | Base 1-19 |
| 46-CR2 | 296 | Base 1-20 |

TABLE 7

Guide RNA/Cas9 used in Maize Stable Transformation for the Complex Trait Locus 2 (CTL2) on Zm01

| Experiment | Guide RNA/Cas9 | SEQ ID NO: |
|---|---|---|
| 62-CR1 | ZM-U6:62CR1 + UBI:CAS9 (PHP71924) | 136 |
| 27-CR1 | ZM-U6:27CR1 + UBI:CAS9 (PHP71918) | 137 |
| 63-CR1 | ZM-U6:63CR1 + UBI:CAS9 (PHP71925) | 138 |
| 64-CR1 | ZM-U6:64CR1 + UBI:CAS9 (PHP71926) | 139 |
| 30-CR1 | ZM-U6:30CR1 + UBI:CAS9 (PHP71920) | 140 |
| 65-CR1 | ZM-U6:65CR1 + UBI:CAS9 (PHP71927) | 141 |
| 66-CR1 | ZM-U6:66CR1 + UBI:CAS9 (PHP71928) | 142 |
| 67-CR1 | ZM-U6:67CR1 + UBI:CAS9 (PHP71930) | 143 |
| 68-CR1 | ZM-U6:68CR1 + UBI:CAS9 (PHP71931) | 144 |
| 34-CR1 | ZM-U6:34CR1 + UBI:CAS9 (PHP71922) | 145 |
| 69-CR1 | ZM-U6:69CR1 + UBI:CAS9 PHP71932) | 146 |

TABLE 8

Guide RNA used in maize Stable Transformation for the Complex Trait Locus (CTL-2) on ZM01-CTL2

| Guide RNA name | SEQ ID NO: | Variable targeting domains |
|---|---|---|
| 62-CR1 | 297 | Base 1-20 |
| 27-CR1 | 298 | Base 1-22 |
| 63-CR1 | 299 | Base 1-19 |
| 64-CR1 | 300 | Base 1-22 |
| 30-CR1 | 301 | Base 1-22 |
| 65-CR1 | 302 | Base 1-22 |
| 66-CR1 | 303 | Base 1-23 |
| 67-CR1 | 304 | Base 1-19 |
| 68-CR1 | 305 | Base 1-20 |
| 34-CR1 | 306 | Base 1-20 |
| 69-CR1 | 307 | Base 1-22 |

Example 4

Delivery of the Guide RNA/Cas9 Endonuclease System DNA to Maize by Stable Transformation The guide RNA/Cas9 DNA constructs and donor DNAs described in Example 3 were co-delivered to an elite maize genome by the stable transformation procedure described below. Transformation of maize immature embryos using particle delivery is performed as follows.

Maize ears are husked and surface sterilized in 30% Clorox bleach plus 0.5% Micro detergent for 20 minutes, and rinsed two times with sterile water. The immature embryos are isolated and placed embryo axis side down (scutellum side up), 25 embryos per plate, on 560Y medium for 4 hours and then aligned within the 2.5-cm target zone in preparation for bombardment. Alternatively, isolated embryos are placed on 560L (Initiation medium) and placed in the dark at temperatures ranging from 26° C. to 37° C. for 8 to 24 hours prior to placing on 560Y for 4 hours at 26° C. prior to bombardment as described above.

Plasmids containing the double strand brake inducing agent and donor DNA are constructed using standard molecular biology techniques and co-bombarded with plasmids containing the developmental genes ODP2 (AP2 domain transcription factor ODP2 (Ovule development protein 2); US20090328252 A1) and Wushel (US2011/0167516).

The plasmids and DNA of interest are precipitated onto 0.6 μm (average diameter) gold pellets using a proprietary lipid-polymer mixture of a water-soluble cationic lipid transfection reagent as follows. DNA solution is prepared on ice using 1 μg of plasmid DNA and optionally other constructs for co-bombardment such as 50 ng (0.5 μl) of each plasmid containing the developmental genes ODP2 (AP2 domain transcription factor ODP2 (Ovule development protein 2); US20090328252 A1, published Dec. 31, 2009) and Wushel. To the pre-mixed DNA, 20 μl of prepared gold particles (15 mg/ml) and 1 μl A of the water-soluble cationic lipid transfection reagent is added in water and mixed carefully. Gold particles are pelleted in a microfuge at 10,000 rpm for 1 min and supernatant is removed. The resulting pellet is carefully rinsed with 100 ml of 100% EtOH without resuspending the pellet and the EtOH rinse is carefully removed. 105 μl of 100% EtOH is added and the particles are resuspended by brief sonication. Then, 10 μl is spotted onto the center of each macrocarrier and allowed to dry about 2 minutes before bombardment.

The final mixture is sonicated briefly and allowed to incubate under constant vortexing for 10 minutes. After the precipitation period, the tubes are centrifuged briefly, liquid is removed, and the particles are washed with 500 ml 100% ethanol, followed by a 30 second centrifugation. Again, the liquid is removed, and 105 µl 100% ethanol is added to the final tungsten particle pellet. For particle gun bombardment, the tungsten/DNA particles are briefly sonicated. 10 µl of the tungsten/DNA particles is spotted onto the center of each macrocarrier, after which the spotted particles are allowed to dry about 2 minutes before bombardment.

The sample plates are bombarded at level #4 with a Biorad Helium Gun. All samples receive a single shot at 450 PSI, with a total of ten aliquots taken from each tube of prepared particles/DNA.

Following bombardment, the embryos are incubated on 560P (maintenance medium) for 12 to 48 hours at temperatures ranging from 26 C to 37 C, and then placed at 26 C. After 5 to 7 days the embryos are transferred to a selection medium containing 150 mg/liter Geneticin (G418), and sub-cultured every 2 weeks at 26 C. After approximately 10 weeks of selection, selection-resistant callus clones are transferred to 288J medium to initiate plant regeneration. Following somatic embryo maturation (2-4 weeks), well-developed somatic embryos are transferred to medium for germination and transferred to a lighted culture room. Approximately 7-10 days later, developing plantlets are transferred to 272V hormone-free medium in tubes for 7-10 days until plantlets are well established. Plants are then transferred to inserts in flats (equivalent to a 2.5" pot) containing potting soil and grown for 1 week in a growth chamber, subsequently grown an additional 1-2 weeks in the greenhouse, then transferred to Classic 600 pots (1.6 gallon) and grown to maturity. Plants are monitored and scored for transformation efficiency, and/or modification of regenerative capabilities.

Initiation medium (560L) comprises 4.0 g/l N6 basal salts (SIGMA C-1416), 1.0 ml/l Eriksson's Vitamin Mix (1000× SIGMA-1511), 0.5 mg/l thiamine HCl, 20.0 g/l sucrose, 1.0 mg/l 2,4-D, and 2.88 g/l L-proline (brought to volume with D-I H2O following adjustment to pH 5.8 with KOH); 2.0 g/l Gelrite (added after bringing to volume with D-I H2O); and 8.5 mg/l silver nitrate (added after sterilizing the medium and cooling to room temperature).

Maintenance medium (560P) comprises 4.0 g/l N6 basal salts (SIGMA C-1416), 1.0 ml/l Eriksson's Vitamin Mix (1000×SIGMA-1511), 0.5 mg/l thiamine HCl, 30.0 g/l sucrose, 2.0 mg/l 2,4-D, and 0.69 g/l L-proline (brought to volume with D-I H2O following adjustment to pH 5.8 with KOH); 3.0 g/l Gelrite (added after bringing to volume with D-I H2O); and 0.85 mg/l silver nitrate (added after sterilizing the medium and cooling to room temperature).

Bombardment medium (560Y) comprises 4.0 g/l N6 basal salts (SIGMA C-1416), 1.0 ml/l Eriksson's Vitamin Mix (1000×SIGMA-1511), 0.5 mg/l thiamine HCl, 120.0 g/l sucrose, 1.0 mg/l 2,4-D, and 2.88 g/l L-proline (brought to volume with D-I H2O following adjustment to pH 5.8 with KOH); 2.0 g/l Gelrite (added after bringing to volume with D-I H2O); and 8.5 mg/l silver nitrate (added after sterilizing the medium and cooling to room temperature).

Selection medium (560R) comprises 4.0 g/l N6 basal salts (SIGMA C-1416), 1.0 ml/l Eriksson's Vitamin Mix (1000× SIGMA-1511), 0.5 mg/l thiamine HCl, 30.0 g/l sucrose, and 2.0 mg/l 2,4-D (brought to volume with D-I H2O following adjustment to pH 5.8 with KOH); 3.0 g/l Gelrite (added after bringing to volume with D-I H2O); and 0.85 mg/l silver nitrate and 3.0 mg/l Geneticin (G418) (both added after sterilizing the medium and cooling to room temperature).

Plant regeneration medium (288J) comprises 4.3 g/l MS salts (GIBCO 11117-074), 5.0 ml/l MS vitamins stock solution (0.100 g nicotinic acid, 0.02 g/l thiamine HCL, 0.10 g/l pyridoxine HCL, and 0.40 g/l glycine brought to volume with polished D-I H2O) (Murashige and Skoog (1962) *Physiol. Plant.* 15:473), 100 mg/l myo-inositol, 0.5 mg/l zeatin, 60 g/l sucrose, and 1.0 ml/l of 0.1 mM abscisic acid (brought to volume with polished D-I H2O after adjusting to pH 5.6); 3.0 g/l Gelrite (added after bringing to volume with D-I H2O); and 1.0 mg/l indoleacetic acid and 3.0 mg/l Geneticin (G418) (added after sterilizing the medium and cooling to 60° C.). Hormone-free medium (272V) comprises 4.3 g/l MS salts (GIBCO 11117-074), 5.0 ml/l MS vitamins stock solution (0.100 g/l nicotinic acid, 0.02 g/l thiamine HCL, 0.10 g/l pyridoxine HCL, and 0.40 g/l glycine brought to volume with polished D-I H2O), 0.1 g/l myo-inositol, and 40.0 g/l sucrose (brought to volume with polished D-I H2O after adjusting pH to 5.6); and 6 g/l bacto-agar (added after bringing to volume with polished D-I H2O), sterilized and cooled to 60° C.

Example 5

Detection of Site-Specific Non-Homologous-End Joining (NHEJ) (Indicative of Target Site Mutation) Mediated by the Guide RNA/Cas9 System in Stably Transformed Maize Genomic DNA was extracted from stable maize shoots (obtained from maize events described in Example 3-4) on maturation plates and analyzed by quantitative PCR using a 7900 real time PCR system (Applied Biosystems, Foster City, Calif.) with target site-specific primers and FAM-labeled fluorescence probe to check copy number changes of the double strand break target sites. The qPCR analysis was done in duplex reactions with Alcohol DeHydrogenases (ADH) as the endogenous controls. The endogenous control probe ADH was labeled with VIC and the gene-specific probes for all the target sites were labeled with FAM for the simultaneous detection of both fluorescent probes (Applied Biosystems). PCR reaction data were captured and analyzed using the sequence detection software provided with the 7900 real time PCR system and the gene copy numbers were calculated using the relative quantification methodology (Applied Biosystems). The primers and probes for obtaining the target site copy number using qPCR at each site were as listed in Table 9 (SEQ ID NO: 147-266).

TABLE 9

Primers/Probes used in qPCR analyses of transgenic maize events

| CTL | Target site | Probe/Primer Name | Sequence | SEQ ID NO: |
|---|---|---|---|---|
| 1 | 49CR2 | 49CR2 MGB Probe | AGCGCCCAGCACC | 147 |
| | | 49CR2_F_1 | GATTGGACGTGCGGCTGT | 148 |
| | | 49CR2_R_1 | TAGCCATCGCGTGCCC | 149 |

TABLE 9-continued

Primers/Probes used in qPCR analyses of transgenic maize events

| CTL | Target site | Probe/Primer Name | Sequence | SEQ ID NO: |
|---|---|---|---|---|
| 1 | 50-CR1 | 50CR1 MGB Probe | CTGCCGTTGTTGTTCA | 150 |
| | | 50CR1_F_1 | TGTGTGAATCCCATTTCTCCTAGA | 151 |
| | | 50CR1_R_1 | AGGTGAAGGATCGGTCGAGA | 152 |
| 1 | 51-CR1 | 51CR1 MGB Probe | TAGGTAGAAATGTGAAGGTC | 153 |
| | | 51CR1_F_1 | AGAGGTTGAGACGCTCCACG | 154 |
| | | 51CR1_R_1 | GTGCGTGCTTTGTTTGTTTCTT | 155 |
| 1 | 41-CR2 | 41CR2 MGB Probe | CCCAAGTAGCAATTACA | 156 |
| | | 41CR2_F_1 | GGCTAGGTAATGGTTGAATCTACATATTA | 157 |
| | | 41CR2_R_1 | TTCTGCGTTTGCTCGCCT | 158 |
| 1 | 72-CR1 | 72CR1 MGB Probe | ACTTCTCCAATGCGTCACA | 159 |
| | | 72CR1_F_1 | AGAAGCAGGCTCGCCAGAA | 160 |
| | | 72CR1_R_1 | GCAACCCCTCCCTCGTCT | 161 |
| 1 | 71-CR1 | 71CR1 MGB Probe | CCTCCATCCTTTTACCTC | 162 |
| | | 71CR1_F_1 | CAGTTGCTGGTATGCCTTGCT | 163 |
| | | 71CR1_R_1 | GCACAGGAGCAACCAGAATCA | 164 |
| 1 | 81-CR1 | 81CR1 MGB Probe | TTGCTGATGGATCAAT | 165 |
| | | 81CR1_F_1 | GGAGAAGAGGTGCCTTGGC | 166 |
| | | 81CR1_R_1 | TATGTTAGCCCTAATCTCGACCGT | 167 |
| 1 | 73-CR1 | 73CR1 MGB Probe | TAGTCCAGTCTTGTCATCGT | 168 |
| | | 73CR1_F_1 | CTTACCATCTTTCATCCTTCGTCTT | 169 |
| | | 73CR1_R_1 | TCCAGTGCATATCGCAGTTCC | 170 |
| 1 | 14-CR4 | 14CR4 MGB Probe | CAAATCCTAAGGAGGACCAT | 171 |
| | | 14CR4_F_1 | TCCGACATAAATCTGTGGTCACAT | 172 |
| | | 14CR4_R_1 | CGCTTCTACCATATGTAGTTGTTGC | 173 |
| 1 | 74-CR1 | 74CR1 MGB Probe | TACTCCATGTGGTCATTGT | 174 |
| | | 74CR1_F_1 | TCTGTCGCTCGTCCAAATCC | 175 |
| | | 74CR1_R_1 | CAGGTGGGAAGCACGAC | 176 |
| 1 | 75-CR1 | 75CR1 MGB Probe | TTGCCGGTCGATGCT | 177 |
| | | 75CR1_F_1 | CGCTTTTTTCTCCTGCTATTCTG | 178 |
| | | 75CR1_R_1 | AAGACAGGCAGTGCCAGAGG | 179 |
| 1 | 84-CR1 | 84CR1 MGB Probe | CCTAAACCTACTCTCTTGAGC | 180 |
| | | 84CR1_F_1 | TGACACTTTGTATTGGTGCTCTTG | 181 |
| | | 84CR1_R_1 | CAAAGGAAAGGGGAGTAACCAAC | 182 |
| 1 | 76-CR1 | 76CR1 MGB Probe | TCTGAATACCCGCTCTAG | 183 |
| | | 76CR1_F_1 | TTCATCTATCCTAATGAGACATCCTCA | 184 |
| | | 76CR1_R_1 | AGGGTCATAATGCAAGACTCGAAT | 185 |
| 1 | 77-CR1 | 77CR1 MGB Probe | TAGTTCCACTCTCGGCAAC | 186 |
| | | 77CR1_F_1 | TGGTGAGAGAAGAGGCTTTTGG | 187 |
| | | 77CR1_R_1 | ACACCTAGCCTAGATGCCTCAGTC | 188 |
| 1 | 78-CR1 | 78CR1 MGB Probe | CCAAGCCTCTGCATCT | 189 |
| | | 78CR1_F_1 | CGAACCTTGTCCGCGTC | 190 |
| | | 78CR1_R_1 | CAAAGTCCCAGAGAGCTTGTTATC | 191 |
| 1 | 85-CR1 | 85CR1 MGB Probe | TGCTCCTTTATCACTAGGTAT | 192 |
| | | 85CR1_F_1 | GAATAAACTAGACGAAAAATGAGGTTGAC | 193 |
| | | 85CR1_R_1 | AGGACTGATGAGACTTGTCTTGAGC | 194 |

TABLE 9-continued

Primers/Probes used in qPCR analyses of transgenic maize events

| CTL | Target site | Probe/Primer Name | Sequence | SEQ ID NO: |
|---|---|---|---|---|
| 1 | 19-CR1 | 19CR1 MGB Probe | TTTGCCAATTCTTTC | 195 |
|   |   | 19CR1_F_1 | GCAAAAGCTCTTAGAATATCCCTTTC | 196 |
|   |   | 19CR1_R_1 | AGCTATAATAAAGTCTTCCCCTCTAGTT | 197 |
| 1 | 86-CR1 | 86CR1 MGB Probe | ATTCTCTGTTAAGGAATGACT | 198 |
|   |   | 86CR1_F_1 | CGGAGCATTTTTCTCCCCA | 199 |
|   |   | 86CR1_R_1 | TGACTACGGATGTCAATGGAGAA | 200 |
| 1 | 43-CR1 | 43CR1 MGB Probe | CCTGCTACTGCGAACC | 201 |
|   |   | 43CR1_F_1 | CCAACCAGCGGCAGAGG | 202 |
|   |   | 43CR1_R_1 | GCAGCGTACATGGCTCATG | 203 |
| 1 | 11-CR1 | 11CR1 MGB Probe | TGTTCCAAATTCTCCTGCCT | 204 |
|   |   | 11CR1_F_1 | GTTCTTATATCTGGCGATAACCACTT | 205 |
|   |   | 11CR1_R_1 | TTGTAGCACTTGCACGTAGTTACATA | 206 |
| 1 | 47-CR2 | 47CR2 MGB Probe | CACATACACTTGCACGGCA | 207 |
|   |   | 47CR2_F_1 | TGGGAGTAGTAGTGAACGGAATACG | 208 |
|   |   | 47CR2_R_1 | TCCAAAAATTATATAGCACGCACG | 209 |
| 1 | 80-CR1 | 80CR1 MGB Probe | CGTCCAAGATTATCTCCT | 210 |
|   |   | 80CR1_F_1 | CCACCACTCTCGCATAATAAGTGA | 211 |
|   |   | 80CR1_R_1 | GCTTGGAATCAGTAGAATGGAACAC | 212 |
| 1 | 52-CR2 | 52CR2 MGB Probe | TAGGCAATTTGTATCTTGCGC | 213 |
|   |   | 52CR2_F_1 | ACACCTCCAGTAGCCACATCC | 214 |
|   |   | 52CR2_R_1 | TGCTTTACGCTAGGTGTGTATCTTACA | 215 |
| 1 | 87-CR1 | 87CR1 MGB Probe | AAACACAGACAAGTTGG | 216 |
|   |   | 87CR1_F_1 | GAATCACATTCTCTCCTCCCTCTT | 217 |
|   |   | 87CR1_R_1 | CGCAGAATCGGCGAGG | 218 |
| 1 | 88-CR1 | 88CR1 MGB Probe | ACTGTCTAAATACTGGTATCTT | 219 |
|   |   | 88CR1_F_1 | GATGGAGGATAGAATTGTATCTTTTAGGA | 220 |
|   |   | 88CR1_R_1 | ACTGTCTTAATTTACTCGACTCTTTCTTA | 221 |
| 1 | 45-CR1 | 45CR1 MGB Probe | ATTGCTCCTCATCCTCGA | 222 |
|   |   | 45CR1_F_1 | CCACGGACTGGATTAGATAGTGGT | 223 |
|   |   | 45CR1_R_1 | TCTAGCTTTGCATCATGTCTTGAAC | 224 |
| 1 | 10-CR3 | 10CR3 MGB Probe | TGTCCCTGTATCTCCAAC | 225 |
|   |   | 10CR3_F_1 | GGCAGGAATCAAGGCTCGT | 226 |
|   |   | 10CR3_R_1 | GCCTCGCCTTCGCTAGTTAA | 227 |
| 1 | 44-CR2 | 44CR2 MGB Probe | AGCCTGAGCCCATGCA | 228 |
|   |   | 44CR2_F_1 | AGCCACCGCACTCCACC | 229 |
|   |   | 44CR2_R_1 | GCTTCTGCGATCTGCGGT | 230 |
| 1 | 46-CR2 | 46CR2 MGB Probe | CCTGTGCCATCGCT | 231 |
|   |   | 46CR2_F_1 | CATGTGGCGAAGGTTGGAT | 232 |
|   |   | 46CR2_R_1 | GGAAGAAAAAGATGTTATCGAAAGC | 233 |
| 2 | 62-CR1 | 62CR1 MGB Probe | AGTTGGATATGTCTAGCCG | 234 |
|   |   | 62CR1_F_1 | TGAGGGAGAAATTAAACATCCAGC | 235 |
|   |   | 62CR1_R_1 | TTGGCGTGAAACGGAGCT | 236 |
| 2 | 27-CR1 | 27CR1 MGB Probe | TGCACCCCGTCGTC | 237 |
|   |   | 27CR1_F_1 | AGAGAAAGCAGATGACACGCAC | 238 |
|   |   | 27CR1_R_1 | CAAATCCGATTACCACACATTAGC | 239 |

TABLE 9-continued

Primers/Probes used in qPCR analyses of transgenic maize events

| CTL | Target site | Probe/Primer Name | Sequence | SEQ ID NO: |
|---|---|---|---|---|
| 2 | 63-CR1 | 63CR1 MGB Probe | AGCTTACATCAGCTTTGGT | 240 |
|   |   | 63CR1_F_1 | TCGAGATAACCCTAGAAAAAATGGTT | 241 |
|   |   | 63CR1_R_1 | GTGGTCCACCATCGAGCAA | 242 |
| 2 | 64-CR1 | 64CR1 MGB Probe | ACCGTGATTGCATTGC | 243 |
|   |   | 64CR1_F_1 | TGGAAACGCTTCATATTCGGA | 244 |
|   |   | 64CR1_R_1 | TCTCTCCGATGCCATTGAACTAG | 245 |
| 2 | 30-CR1 | 30CR1_MGB Probe | AGGAAGGCAACGATG | 246 |
|   |   | 30CR1_F_1 | ATGTTCGCCACCTTTATTTGC | 247 |
|   |   | 30CR1_R_1 | CATCAACCCGTTCTGTCCCT | 248 |
| 2 | 65-CR1 | 65CR1 MGB Probe | TCTCGGCCATGGATT | 249 |
|   |   | I65CR1_F_1 | TGGTCGAACTCTTGCACGG | 250 |
|   |   | 65CR1_R_1 | ATTTTTTGAACAAGAACCGTGGAC | 251 |
| 2 | 66-CR1 | 66CR1 MGB Probe | CTGGCCGCTAGAAC | 252 |
|   |   | 66CR1_F_1 | CGGAAAAGGAACAGTCTTGATTG | 253 |
|   |   | 66CR1_R_1 | TGTGCTCTCTACCTTTGCATGTG | 254 |
| 2 | 67-CR1 | 67CR1 MGB Probe | CGGAACTGTGAGTGACG | 255 |
|   |   | 67CR1_F_1 | CTAGCCTAGCAGGAGTACGAGTTGT | 256 |
|   |   | 67CR1_R_1 | TGTCCTAGTTTTTCATCTGCAATCTG | 257 |
| 2 | 68-CR1 | 68CR1 MGB Probe | ATGGTCCACTTTGATAGC | 258 |
|   |   | 68CR1_F_1 | GGTCGTAGTGCCGTTGATGG | 259 |
|   |   | 68CR1_R_1 | CCAGTCCCTGTGTACGTGTGC | 260 |
| 2 | 34-CR1 | 34CR1 MGB Probe | ACACACGTACTGCGGCGT | 261 |
|   |   | 34CR1_F_1 | TGTCTTTCTTGTCGCTGTGGAT | 262 |
|   |   | 34CR1_R_1 | CCACACGTCGTCCGAGTTC | 263 |
| 2 | 69-CR1 | 69CR MGB Probe | AACTCGTAAACCTAGCGCT | 264 |
|   |   | 69CR1_F_1 | TAGCCGAAACATGACCTCTTTGA | 265 |
|   |   | 69CR1_R_1 | ACCCCAATAAAACCCCCTAGC | 266 |

The "Event Recovery frequency" was calculated using the number of events recovered divided by the total number of embryos bombarded, and may indicate if an endonuclease has some toxic effect or not. Hence, if 1000 embryos were bombarded and 200 were recovered, the Event Recovery frequency is 20%. Table 10 and Table 11 indicate that for all target sites analyzed so far, the Event Recovery frequency ranged between 14% and 39%. Targets like 74-CR1 with lower event recovery (14%) indicated some toxicity for this guide RNA/Cas system. Overall, the guide RNA/Cas system used herein showed low toxicity with variation from guide to guide.

Cas endonuclease activity was measured in-planta by determining the "Target Site Mutation frequency" (Tables 10-11) which is defined as: (number of events with target site modification/total number recovered events)*100%. Hence, if 200 events were recovered and 160 events showed a mutation, the Target Site Mutation frequency is 80%. The target site mutation was measured using target site allele copy number as described in Example 18 of as described in U.S. patent application Ser. No. 14/463,687, filed on Aug. 20, 2014, incorporated by reference herein. In short, if no modification of the target site was observed, the event would be called wild type (WT), both alleles are intact, target site copy number would be 2. Events with one allele modified due to double strand break, have the target site copy number reduced to 1 (one allele). Events with both alleles of the target site modified, have a copy number of 0 (null). Events that were identified to have a target site mutation included both one allele and null events.

As shown in Table 10 and Table 11, the target site mutation frequency (Cas9 endonuclease activity) varied from target site to target site (ranging from between about 32 to about 98%), and most target sites' mutation frequency was above 50%. Over all, the guide RNA/Cas system was a very efficient double strand break system.

TABLE 10

Target site mutations and site specific gene integrations induced by the guide RNA/Cas9 system on a genomic window referred to as Complex Trait Locus 1 (CTL1) on Zm01 in maize

| Target | Event Recovery frequency (%) | Target Site Mutation frequency (%) | Insertion frequency (HR1 + HR2) (%) |
|---|---|---|---|
| 49-CR2 | 19% | 93% | 1% (3) |
| 50--CR1 | 24% | 83% | 4% (8) |
| 41-CR2 | 39% | 62% | 3% (9) |
| 72-CR1 | 25% | 93% | 2% (7) |
| 71-CR1 | 27% | 97% | 5% (13) |
| 81-CR1 | 22% | 77% | 3% (6) |
| 73-CR1 | 24% | 75% | 3% (7) |
| 14-CR4 | 27% | 98% | 1% (2) |
| 74-CR1 | 14% | 80% | 1% (1) |
| 75-CR1 | 20% | 80% | 3% (6) |
| 84-CR1 | 25% | 75% | 2% (6) |
| 76-CR1 | 26% | 75% | 7% (19) |
| 77-CR1 | 20% | 73% | 3% (7) |
| 78-CR1 | 27% | 57% | 2% (7) |
| 85-CR1 | 19% | 76% | 0.5% (1) |
| 19-CR1 | 31% | 32% | 0 |
| 86-CR1 | 22% | 85% | 3% (7) |
| 8-CR1 | 21% | 94% | 5% (9) |
| 43-CR1 | 18% | 79% | 1% (2) |
| 11-CR1 | 19% | 98% | 4% (7) |
| 47-CR1 | 20% | 86% | 4% (7) |
| 80-CR1 | 26% | 98% | 2% (4) |
| 87-CR1 | 23% | 99% | 5% (12) |
| 45-CR1 | 27% | 90% | 7% (20) |
| 44-CR2 | 24% | 90% | 4% (9) |

TABLE 11

Target Site Mutations and Site Specific Gene Integration Induced by the Guide RNA/Cas9 system on a genomic window referred to as CTL2 on Zm01 in maize

| Target site | #Event recovery frequency (%) | Target site mutation frequency (%) | Insertion (HR1 + HR2) frequency (%) |
|---|---|---|---|
| 62-CR1 | 26% | 95% | 1% (4) |
| 27CR1 | 20% | 97% | 2% (4) |
| 63-CR1 | 23% | 91% | 6% (15) |
| 64-CR1 | 27% | 84% | 5% (17) |
| 30CR1 | 20% | 91% | 1% (1) |
| 65-CR1 | 29% | 90% | 3% (13) |
| More in progress. | | | |

Example 6

Introducing Transgenic SSI Target Sites within a Maize Genomic Window Using the Guide RNA/Cas9 Endonuclease System In order to develop a Complex Trait Locus in a genomic window of the maize genome, a method was developed to introduce transgenic SSI (site specific Integration) target sites in close proximity to a maize genomic locus of interest using the guide RNA/Cas9 endonuclease system. First, a genomic window was identified into which multiple SSI target sites in close proximity can be introduced (FIG. 2A, FIGS. 4-7, and Example 2). The DNA sequence of the genomic window was than evaluated for the presence of any double strand break target sites, specifically for the presence of any Cas9 endonuclease target sites. Any 12-30 bp genomic DNA sequence following the pattern NGG can be selected as a target site for the guide RNA/Cas9 endonuclease system. A guide RNA and a Cas endonuclease can be introduced either through the use of expression cassettes (as described in Example 3 and Example 4, FIG. 2C), or can directly be provided to a maize cell comprising any one of the Cas9 endonuclease target sites, wherein said guide RNA and Cas endonuclease are capable of forming a complex that enables the Cas endonuclease to introduce a double strand break at the Cas endonuclease target site. These maize cells were provided with a donor DNA comprising a transgenic SSI target site comprising two recombination sites (such as but not limited to FRT1, FRT87, FRT6, FIG. 2B) flanked by a first and second region of homology (FIG. 2B). Optionally, the donor DNA can contain a polynucleotide of interest between the two FRT sites. These maize cells were then evaluated for the target site mutation indicating that the guide RNA/Cas endonuclease system was functional and capable of introducing a double strand break (Example 5). Upon cleavage of the Cas9 endonuclease target site, the transgenic SSI target site was introduced into the DSB target site resulting into a modified double strand break target site (aDSB, FIG. 2D) comprising a transgenic SSI target site.

Figure 8:
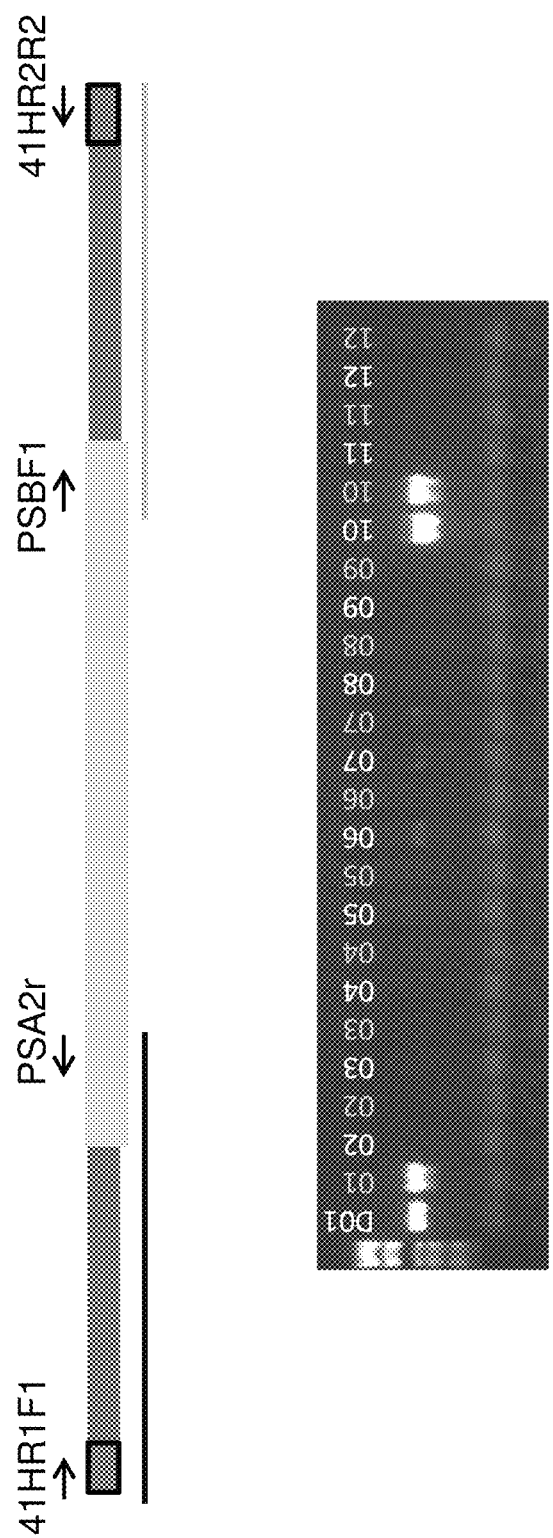
FIG. 8 shows a junction PCR screen for identification of insertion events at one locus on chromosome 1 of maize. A gel picture indicates the presence of insertion events at the Cas endonuclease 41-CR target site (see white bands in lanes D1 and D10). PCR reactions of HR1 and HR2 junction were loaded next to each other (white label and lane gray label), with white label representing HR1 junction PCR, gray label representing HR2 junction PCR.

The integration of the transgenic SSI target sites via guide RNA/Cas9 system mediated DNA homologous recombination was determined by border-specific PCR analysis at both possible transgene genomic DNA junctions at different DSB target sites. For Example, the 5' end borders of 41-CR1 events (FIG. 8) were amplified as a 660 bp 41 HR1 PCR amplicon by PCR with primers while the 3' borders of the same events were amplified as a 655 bp HR2PCR amplicon. Any event with both the 5' border and 3' border-specific bands amplified was considered as a site-specific integration event containing the transgene target site from the donor DNA fragment. All the border-specific PCR fragments were sequenced and were all confirmed to be recombined sequences. Border PCR assays for other DSB sites were carried out with the same approach with the specific border primers. On average, integration of the transgenic target sites through the guide RNA/Cas9 mediated homologous recombination occurred at 0.5% to 7% of the total recovered transgenic events (Insertion frequency, Table 10 and 11). Integration events were obtained in 28 out of 30 sites at CTL1 region, a 90% successful rate without any pre-screening indicating that the guide RNA/Cas endonuclease system is very robust and efficient system for introducing transgenic target sites at specific genomic locations.

The Introduction of the transgenic SSI target sites comprising the FRT1 and FRT87 (or FRT6) recombination sites in these Cas9 endonuclease target sites enables the use the FLP/FRT technology to perform gene stacking by the SSI technology and develop a complex trait loci within a genomic window.

Example 7

DNA Constructs to Test the Guide RNA/Cas Endonuclease System for Soybean Genome Modifications A soybean codon optimized Cas9 (SO) gene (SEQ ID NO: 313) from *Streptococcus pyogenes* M1 GAS (SF370) was expressed with a strong soybean constitutive promoter GM-EF1A2 (described in U.S. Pat. No. 8,697,817, issued on Apr. 15, 2014). A simian vacuolating virus 40 (SV40) large T-antigen nuclear localization signal PKKKRKV with a linker SRAD, (SRADPKKKRKV SEQ ID NO: 314) was added to the carboxyl terminus of the codon optimized Cas9 to facilitate transporting the codon optimized Cas9 protein to the nucleus. In some other constructs, the Simian virus 40 (SV40) monopartite nuclear localization signal (MAPKKKRKV, SEQ ID NO: 309) was incorporated at the amino terminal and *Agrobacterium tumefaciens* bipartite VirD2 T-DNA border endonuclease nuclear localization signal (KRPRDRHDGELGGRKRAR; SEQ ID NO: 310) were incorporated at the carboxyl-termini of the Cas9 open reading frame respectively. The codon optimized Cas9 gene was synthesized as two pieces by GenScript USA Inc. (Piscataway, N.J.) and cloned in frame downstream of the GM-EF1A2 promoter to make Cas9 expression DNA constructs (as described in U.S. patent application Ser. No. 14/463,687 filed on Aug. 20, 2014)

Approximately 0.5 kb genomic DNA sequence upstream of the first G nucleotide of a soybean U6 small nuclear RNA (snRNA) genes was selected to be used as a RNA polymerase III promoter (as described in U.S. patent application Ser. No. 14/463,687 filed on Aug. 20, 2014). For example, GM-U6-13.1 promoter, (SEQ ID NO: 315), was used to express guide RNAs which direct Cas9 nuclease to designated genomic sites (as described in U.S. patent application Ser. No. 14/463,687 filed on Aug. 20, 2014). The guide RNA coding sequence was 76 bp long and comprised a 19 to 20 bp variable targeting domain from a chosen soybean genomic target site on the 5' end and a tract of 4 or more T residues as a transcription terminator on the 3' end. The first nucleotide of the 20 bp variable targeting domain was a G residue to be used by RNA polymerase III for transcription initiation. If the first base is not endogenously a G residue it can be replaced with a G residue in guide RNA target sequence to accommodate RNA polymerase III, which should not sacrifice recognition specificity of the target site by the guide RNA. The U6 gene promoter and the complete guide RNA was synthesized and then cloned into an appropriate vector.

The Cas9 endonuclease and guide RNA expression cassettes were linked into a single DNA construct (as described in U.S. patent application Ser. No. 14/463,687 filed on Aug. 20, 2014), which was then used to transform soybean cells to test the soybean optimized guide RNA/Cas system for genome modification. Similar DNA constructs were made to target different genomic sites using guide RNAs containing different target sequences as described in Example 9.

Example 8

Selection of Soybean Genomic Windows for the Introduction of Transgenic SSI Target Sites by the Guide RNA/Cas Endonuclease System and Complex Trait Loci Development Three soybean genomic regions (also referred to as genomic windows) were identified for the production of Complex Trait Loci comprising a combination of transgenic SSI sites introduced into that genomic window by a soybean optimized guide RNA/Cas9 endonuclease system described herein.

Figure 9:
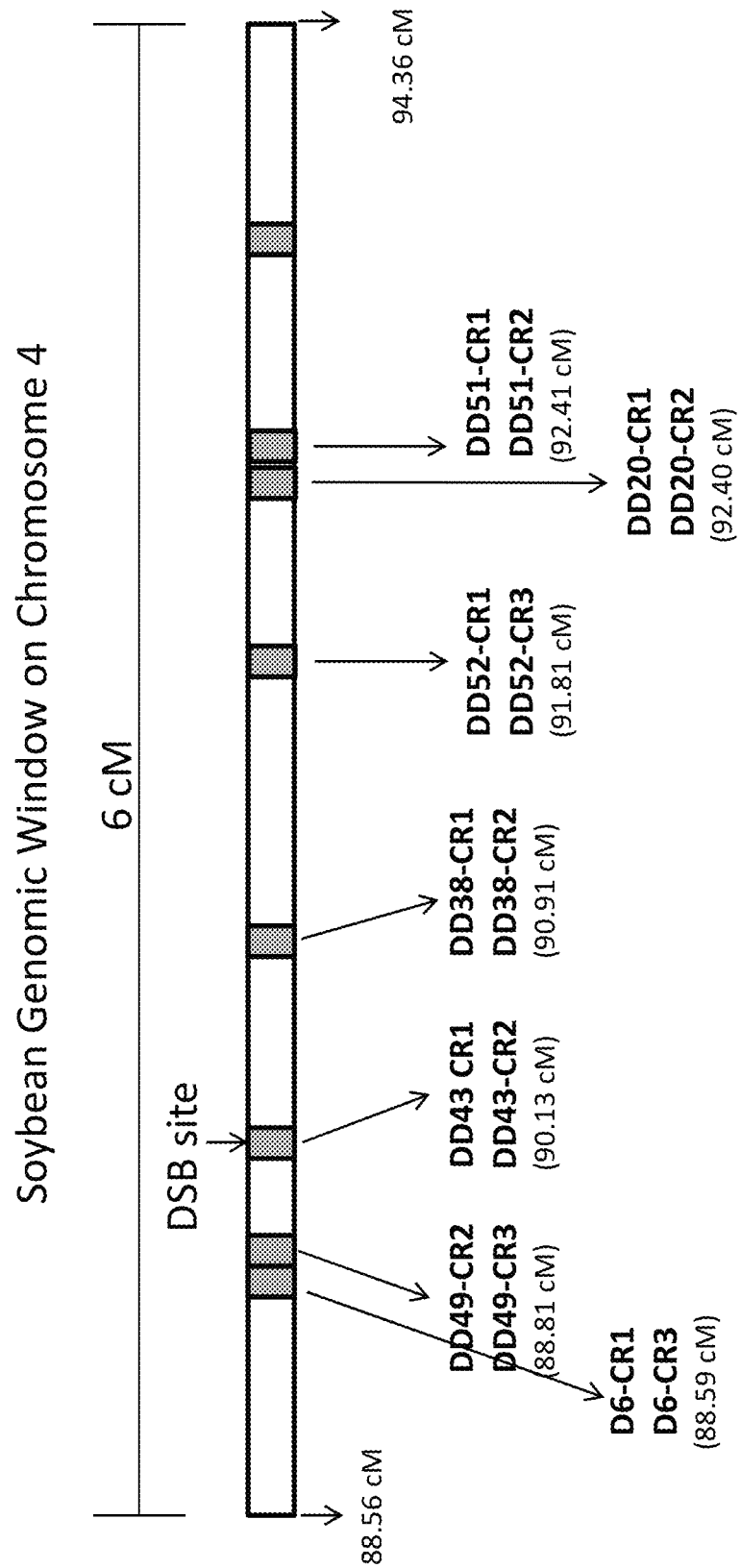
FIG. 9 shows a schematic of a soybean genomic window (CTL-D) on chromosome 4. The genomic window is about 4 cM in length and shows 14 Cas endonuclease target sites (represented by grey boxes). Genomic locations are indicated as cM.

The first soybean genomic window that was identified for the development of a Complex Trait Locus (CTL) spans from Gm04:45593558 (flanked by public SNP marker BARC_1.01_Gm04_45591011_C_T) to Gm04:45937320 (flanked by public SNP marker BARC_1.01_Gm04_46113406_T_G) on chromosome 4 (FIG. 9). Table 12 shows the physical and genetic map position for a multitude of soybean SNP markers (Song, Q et al. (2013), Development and evaluation of SoySNP50K, a high-density genotyping array for soybean. PloS one, 8(1), e54985) and Cas endonuclease target sites (D6-CR1, D6-CR3, DD49-CR2, DD49-CR3, DD43-CR1, DD43-CR2, DD38-CR1, DD38-CR2, DD52-CR1, DD52-CR3, DD20-CR1, DD20-CR2, DD51-CR1 and DD51-CR2) within this genomic window of interest on the soybean chromosome 4. The genetic map positions of a public 4.0 soybean genetic map as well as the genetic map position of an internally derived DuPont-Pioneer map (PHB) are shown in Table 12.

TABLE 12

Genomic Window comprising a Complex Trait Locus D (CTL-D) on Chromosome 4 of soybean.

| Name of public SNP markers (*) or Cas endonuclease target site | Cas endo- nuclease target or SNP marker sequence (SEQ ID NO:) | Physical location | Genetic Position Public 4.0 map | Genetic Position PHB map |
|---|---|---|---|---|
| BARC_1.01_Gm04_45591011_C_T (*) | 316 | Gm04:45591011 | 88.56 | 103.29 |
| D6-CR1 | 317 | Gm04:45593558 . . . 45593579 | 88.59 | 103.30 |
| D6-CR3 | 318 | Gm04:45593565 . . . 45593544 | 88.59 | 103.30 |
| DD49-CR2 | 319 | Gm04:45613212 . . . 45613234 | 88.81 | 103.45 |
| DD49-CR3 | 320 | Gm04:45613246 . . . 45613267 | 88.81 | 103.45 |
| BARC_1.01_Gm04_45613405_T_C (*) | 321 | Gm04:45613405 | 88.81 | 103.45 |
| BARC_1.01_Gm04_45697256_G_A (*) | 322 | Gm04:45697256 | 89.74 | 104.06 |
| DD43-CR1 | 323 | Gm04:45731943 . . . 45731921 | 90.13 | 104.43 |
| DD43-CR2 | 324 | Gm04:45731917 . . . 45731895 | 90.13 | 104.43 |
| BARC_1.01_Gm04_45739051_A_C (*) | 325 | Gm04:45739051 | 90.21 | 104.51 |
| BARC_1.01_Gm04_45800267_T_C (*) | 326 | Gm04:45800267 | 90.89 | 105.07 |
| DD38-CR1 | 327 | Gm04:45802466 . . . 45802445 | 90.91 | 105.10 |
| DD38-CR2 | 328 | Gm04:45802465 . . . 45802486 | 90.91 | 105.10 |
| BARC_1.01_Gm04_45857325_T_C (*) | 329 | Gm04:45857325 | 91.52 | 105.74 |
| BARC_1.01_Gm04_45883080_A_G (*) | 330 | Gm04:45883080 | 91.80 | 105.94 |
| DD52-CR1 | 331 | Gm04:45883701 . . . 45883680 | 91.81 | 105.95 |
| DD52-CR3 | 332 | Gm04:45883685 . . . 45883664 | 91.81 | 105.95 |
| BARC_1.01_Gm04_45903617_T_C (*) | 333 | Gm04:45903617 | 92.03 | 106.11 |
| DD20-CR1 | 334 | Gm04:45936311 . . . 45936333 | 92.40 | 106.37 |
| DD20-CR2 | 335 | Gm04:45936324 . . . 45936346 | 92.40 | 106.37 |
| DD51-CR1 | 336 | Gm04:45937312 . . . 45937333 | 92.41 | 106.38 |
| DD51-CR2 | 337 | Gm04:45937298 . . . 45937320 | 92.41 | 106.38 |

TABLE 12-continued

Genomic Window comprising a Complex Trait Locus D (CTL-D) on Chromosome 4 of soybean.

| Name of public SNP markers (*) or Cas endonuclease target site | Cas endo-nuclease target or SNP marker sequence (SEQ ID NO:) | Physical location | Genetic Position Public 4.0 map | Genetic Position PHB map |
|---|---|---|---|---|
| BARC_1.01_Gm04_46000185_C_A (*) | 338 | Gm04:46000185 | 93.10 | 106.88 |
| BARC_1.01_Gm04_46113406_T_G (*) | 339 | Gm04:46113406 | 94.36 | 107.53 |

Figure 10:
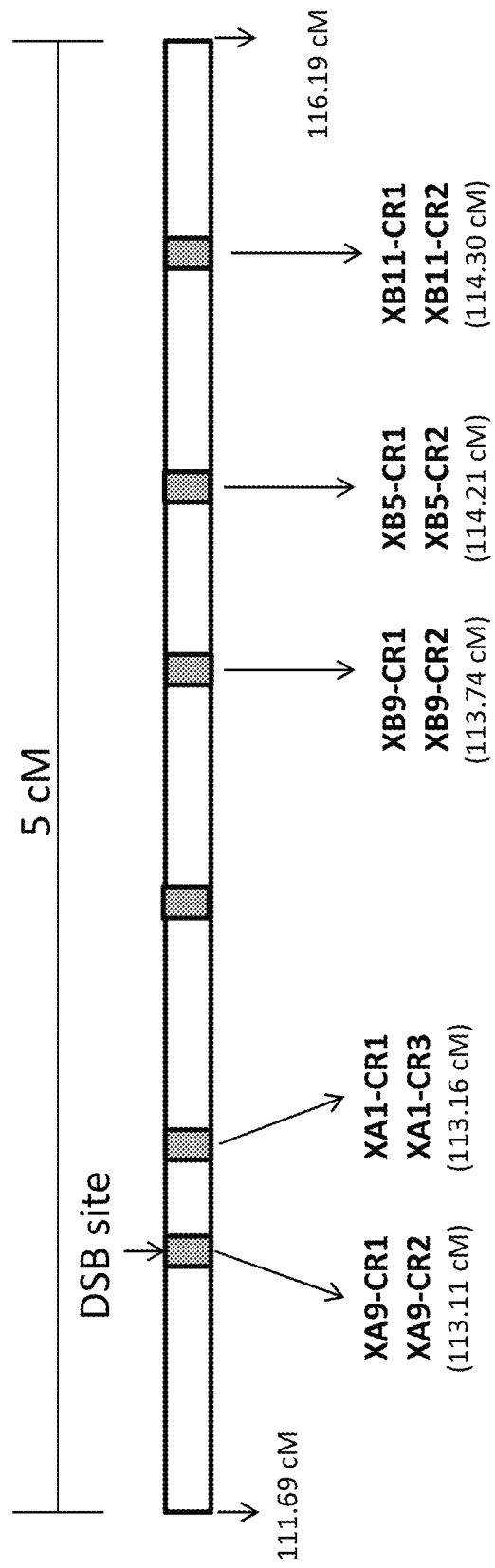
FIG. 10 shows a schematic of a soybean genomic window (CTL-X) on chromosome 6. The genomic window is about 5 cM in length and shows 10 Cas endonuclease target sites (represented by grey boxes). Genomic locations are indicated as cM.

The second soybean genomic window that was identified for the development of a Complex Trait Locus (CTL) spans from Gm06:47537067 (flanked by public SNP marker BARC_1.01_Gm06_46915875_T_C) to Gm06:47864578 (flanked by public SNP marker BARC_1.01_Gm06_48528885_G_T) on chromosome 6 (FIG. 10). Table 13 shows the physical and genetic map position for a multitude of soybean SNP markers (Song, Q et al. (2013) PloS one, 8(1), e54985) and Cas endonuclease target sites (XA9-CR1, XA9-CR2, XA1-CR1, XA1-CR3, XB9-CR1, XB9-CR2, XB5-CR1, XB5-CR2, XB11-CR1, XB11-CR2) within this genomic window of interest on the soybean chromosome 6.

TABLE 13

Genomic Window comprising a Complex Trait Locus X (CTL-X) on Chromosome 6 of soybean.

| Name of public SNP markers (*) or Cas endonuclease target site | Cas endo-nuclease target or SNP marker sequence (SEQ ID NO:) | Physical location | Genetic Position Public 4.0 map | Genetic Position PHB map |
|---|---|---|---|---|
| BARC_1.01_Gm06_46915875_T_C (*) | 340 | Gm06:46915875 | 111.69 | 131.45 |
| BARC_1.01_Gm06_47524452_G_T (*) | 341 | Gm06:47524452 | 113.11 | 134.14 |
| XA9-CR1 | 342 | Gm06:47537067 . . . 47537089 | 113.11 | 134.20 |
| XA9-CR2 | 343 | Gm06:47537127 . . . 47537106 | 113.11 | 134.20 |
| BARC_1.01_Gm06_47561262_C_T (*) | 344 | Gm06:47561262 | 113.13 | 134.31 |
| BARC_1.01_Gm06_47625670_C_T (*) | 345 | Gm06:47625670 | 113.16 | 134.72 |
| XA1-CR1 | 346 | Gm06:47626401 . . . 47626422 | 113.16 | 134.73 |
| XA1-CR3 | 347 | Gm06:47626395 . . . 47626374 | 113.16 | 134.73 |
| BARC_1.01_Gm06_47631544_T_C (*) | 348 | Gm06:47631544 | 113.16 | 134.77 |
| BARC_1.01_Gm06_47789229_C_T (*) | 349 | Gm06:47789229 | 113.41 | 135.92 |
| XB9-CR1 | 350 | Gm06:47802683 . . . 47802704 | 113.74 | 136.07 |
| XB9-CR2 | 351 | Gm06:47802756 . . . 47802778 | 113.75 | 136.08 |
| BARC_1.01_Gm06_47821576_T_G (*) | 352 | Gm06:47821576 | 114.18 | 136.29 |
| BARC_1.01_Gm06_47829363_A_C (*) | 353 | Gm06:47829363 | 114.21 | 136.38 |
| XB5-CR1 | 354 | Gm06:47830474.47830496 | 114.21 | 136.39 |
| XB5-CR2 | 355 | Gm06:47830453.47830474 | 114.21 | 136.39 |
| BARC_1.01_Gm06_47833095_A_G (*) | 356 | Gm06:47833095 | 114.22 | 136.42 |
| BARC_1.01_Gm06_47847021_G_T (*) | 357 | Gm06:47847021 | 114.26 | 136.60 |
| XB11-CR1 | 358 | Gm06:47864569 . . . 47864590 | 114.30 | 136.93 |
| XB11-CR2 | 359 | Gm06:47864557 . . . 47864578 | 114.30 | 136.93 |
| BARC_1.01_Gm06_47895876_G_A (*) | 360 | Gm06:47895876 | 114.39 | 137.53 |
| BARC_1.01_Gm06_48221293_T_C (*) | 361 | Gm04:48221293 | 115.32 | 140.63 |
| BARC_1.01_Gm06_48528885_G_T (*) | 362 | Gm06:48528885 | 116.19 | 143.52 |

Figure 11:
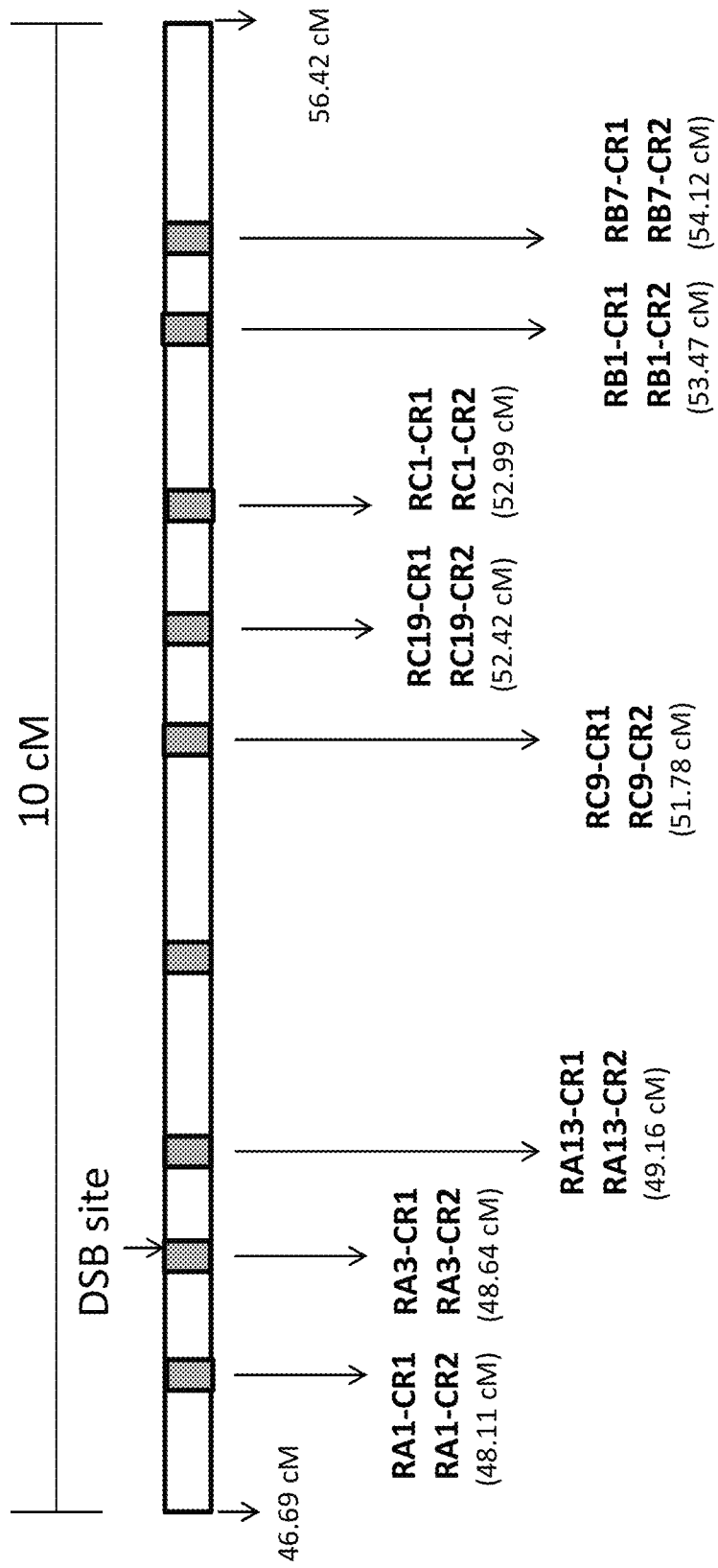
FIG. 11 shows a schematic of a soybean genomic window (CTL-R) on chromosome 6. The genomic window is about 4 cM in length and shows 16 Cas endonuclease target sites (represented by grey boxes). Genomic locations are indicated as cM.

The third soybean genomic window that was identified for the development of a Complex trait Locus (CTL) spans from Gm01:7835614 (flanked by public SNP marker BARC_1.01_Gm01_6984873_T_C) to Gm01:32717275 (flanked by public SNP marker BARC_1.01_Gm01_36994849_A_G) on chromosome 1 (FIG. 11). Table 14 shows the physical and genetic map position for a multitude of soybean SNP markers (Song, Q et al. (2013). Development and evaluation of SoySNP50K, a high-density genotyping array for soybean. PloS one, 8(1), e54985) and Cas endonuclease target sites (RA1-CR1, RA1-CR2, RA3-CR1, RA3-CR2, RA13-CR1, RA13-CR2, RC9-CR1, RC9-CR2, RC19-CR1, RC19-CR2, RC1-CR1, RC1-CR2, RB1-CR1, RB1-CR2, RB7-CR1 and RB7-CR2) within this genomic window of interest on the soybean chromosome 1.

TABLE 14

Genomic Window comprising a Complex Trait Locus R (CTL-R) on Chromosome 1 of soybean.

| Name of public SNP markers (*) or Cas endonuclease target site | Cas endonuclease target or SNP marker sequence (SEQ ID NO:) | Physical location | Genetic Position PHB map |
|---|---|---|---|
| BARC_1.01_Gm01_6984873_T_C (*) | 363 | Gm01:6984873 | 46.69 |
| BARC_1.01_Gm01_7775299_G_A (*) | 364 | Gm01:7775299 | 48.08 |
| RA1-CR1 | 365 | Gm01:7835614 ... 7835635 | 48.11 |
| RA1-CR2 | 366 | Gm01:7835636 ... 7835615 | 48.11 |
| BARC_1.01_Gm01_7856395_A_C (*) | 367 | Gm01:7856395 | 48.12 |
| BARC_1.01_Gm01_8569887_A_G (*) | 368 | Gm01:8569887 | 48.54 |
| BARC_1.01_Gm01_8601858_C_T (*) | 369 | Gm01:8601858 | 48.59 |
| RA3-CR1 | 370 | Gm01:8640527 ... 8640505 | 48.64 |
| RA3-CR2 | 371 | Gm01:8640496 ... 8640518 | 48.64 |
| BARC_1.01_Gm01_8641430_C_T (*) | 372 | Gm01:8641430 | 48.64 |
| BARC_1.01_Gm01_8674202_A_C (*) | 373 | Gm01:8674202 | 48.73 |
| BARC_1.01_Gm01_8933345_C_T (*) | 374 | Gm01:8933345 | 49.11 |
| BARC_1.01_Gm01_8964201_T_C (*) | 375 | Gm01:8964201 | 49.16 |
| RA13-CR1 | 376 | Gm01:8967870 ... 8967891 | 49.16 |
| RA13-CR2 | 377 | Gm01:8967909 ... 8967888 | 49.16 |
| BARC_1.01_Gm01_9014216_T_G (*) | 378 | Gm01:9014216 | 49.23 |
| BARC_1.01_Gm01_28179606_A_G (*) | 379 | Gm01:28179606 | 51.53 |
| RC9-CR1 | 380 | Gm01:28347890 ... 28347912 | 51.78 |
| RC9-CR2 | 381 | Gm01:28347966 ... 28347987 | 51.78 |
| BARC_1.01_Gm01_28364595_A_G (*) | 382 | Gm01:28364595 | 51.83 |
| BARC_1.01_Gm01_28536363_G_A (*) | 383 | Gm01:28536363 | 52.34 |
| RC19-CR1 | 384 | Gm01:28565100 ... 28565078 | 52.42 |
| RC19-CR2 | 385 | Gm01:28565047 ... 28565069 | 52.42 |
| BARC_1.01_Gm01_28599526_G_A (*) | 386 | Gm01:28599526 | 52.52 |
| BARC_1.01_Gm01_28913996_A_G (*) | 387 | Gm01:28913996 | 52.98 |
| RC1-CR1 | 388 | Gm01:28943206 ... 28943228 | 52.99 |
| RC1-CR2 | 389 | Gm01:28943240 ... 28943219 | 52.99 |
| BARC_1.01_Gm01_29284158_A_G (*) | 390 | Gm01:29284158 | 53.15 |
| BARC_1.01_Gm01_31202345_C_T (*) | 391 | Gm01:31202345 | 53.31 |
| RB1-CR1 | 392 | Gm01:31769791 ... 31769813 | 53.47 |
| RB1-CR2 | 393 | Gm01:31769811 ... 31769789 | 53.47 |
| BARC_1.01_Gm01_31770743_C_T (*) | 394 | Gm01:31770743 | 53.47 |
| BARC_1.01_Gm01_32683433_G_A (*) | 395 | Gm01:32683433 | 54.11 |
| RB7-CR1 | 396 | Gm01:32717222 ... 32717243 | 54.12 |
| RB7-CR2 | 397 | Gm01:32717275 ... 32717253 | 54.12 |
| BARC_1.01_Gm01_34327255_C_T (*) | 398 | Gm01:34327255 | 54.80 |
| BARC_1.01_Gm01_36994849_A_G (*) | 399 | Gm01:36994849 | 56.42 |

Example 9

Guide RNA Expression Cassettes, Cas9 Endonuclease Expression Cassettes and Donor DNA's for Introduction of Transgenic SSI Target Sites in a Soybean Genomic Window The soybean U6 small nuclear RNA promoters GM-U6-9.1 (SEQ ID NO: 414) or GM-U6-13.1 (SEQ ID. NO: 315) were used to express guide RNAs to direct Cas9 nuclease to designated genomic target sites (Table 15). A soybean codon optimized Cas9 endonuclease expression cassette and a guide RNA expression cassette were linked in a first plasmid that was co-delivered with a second plasmid comprising a donor DNA (repair DNA) cassette. The donor DNA contained FRT1/FRT87 recombination sites for site specific integration, flanking a selectable marker (such as but not limited to the hygromycin selectable Marker (HPT) and a terminator (such as but not limited to a nopaline synthase terminator, NOS) (FIG. 2B) which upon integration by homologous recombination with the guide RNA/Cas9 endonuclease system created the FRT1/FRT87 target lines for SSI technology application (FIG. 2D).

The guide RNA (gRNA)/Cas9 DNA constructs targeting various soybean genomic sites that were constructed for the introduction of transgenic SSI target sites into Cas endonuclease target sites through homologous recombination are listed in Table 15, Table 16, and Table 17. Tables 18, 19, and 20 list the guide RNAs that were expressed from the guide RNA constructs and the bases of the guide RNA that comprise the variable targeting domain are as well. All the guide RNA/Cas9 constructs differed only in the 19 to 20 bp guide RNA variable targeting domain targeting the soybean genomic target sites. All the donor DNA constructs differed only in the homologous regions such as D6HR1 and D6HR2. These guide RNA/Cas9 DNA constructs and donor DNAs were co-delivered to elite (93B86) or a non-elite (Jack) soybean genome by the stable transformation procedure described in Example 10.

TABLE 15

Guide RNA/Cas9 used in Soybean Stable Transformation for the Complex Trait Locus, CTL-D, on Gm04

| Experiment | Guide RNA/Cas9 | SEQ ID NOs: |
|---|---|---|
| U6-13.1D6CR1 | U6-13.1:D6CR1 + EF1A2:CAS9 (QC882) | 400 |
| U6-13.1D6CR3 | U6-13.1:D6CR3 + EF1A2:CAS9 (QC883) | 401 |
| U6-13.1DD49CR2 | U6-13.1:DD49CR2 + EF1A2:CAS9 (QC884) | 402 |

TABLE 15-continued

Guide RNA/Cas9 used in Soybean Stable Transformation for the Complex Trait Locus, CTL-D, on Gm04

| Experiment | Guide RNA/Cas9 | SEQ ID NOs: |
|---|---|---|
| U6-13.1DD49CR3 | U6-13.1:DD49CR3 + EF1A2:CAS9 (QC885) | 403 |
| U6-9.1DD43CR1 | U6-9.1:DD43CR1 + EF1A2:CAS9 (QC799) | 404 |
| U6-13.1DD43CR2 | U6-13.1:DD43CR2 + EF1A2:CAS9 (QC816) | 405 |
| U6-13.1DD38CR1 | U6-13.1:DD38CR1 + EF1A2:CAS9 (QC886) | 406 |
| U6-13.1DD38CR2 | U6-13.1:DD38CR2 + EF1A2:CAS9 (QC887) | 407 |
| U6-13.1DD52CR1 | U6-13.1:DD52CR1 + EF1A2:CAS9 (QC888) | 408 |
| U6-13.1DD52CR3 | U6-13.1:DD52CR3 + EF1A2:CAS9 (QC889) | 409 |
| U6-9.1DD20CR1 | U6-9.1:DD20CR1 + EF1A2:CAS9 (QC810) | 410 |
| U6-13.1DD20CR2 | U6-13.1:DD20CR2 + EF1A2:CAS9 (QC818) | 411 |
| U6-13.1DD51CR1 | U6-13.1:DD51CR1 + EF1A2:CAS9 (QC890) | 412 |
| U6-13.1DD51CR2 | U6-13.1:DD51CR2 + EF1A2:CAS9 (QC891) | 413 |

TABLE 16

Guide RNA/Cas9 used in Soybean Stable Transformation for the Complex Trait Locus, CTL-X, on Gm06.

| Experiment | Guide RNA/Cas9 | SEQ ID NOs: |
|---|---|---|
| U6-13.1XA9CR1 | U6-13.1:XA9CR1 + EF1A2:CAS9 (RTW1116) | 415 |
| U6-13.1XA9CR2 | U6-13.1:XA9CR2 + EF1A2:CAS9 (RTW1117) | 416 |
| U6-13.1XA1CR1 | U6-9.1:XA1CR1 + EF1A2:CAS9 (RTW1114) | 417 |
| U6-13.1XA1CR3 | U6-13.1:XA1CR3 + EF1A2:CAS9 (RTW1181) | 418 |
| U6-13.1XB9CR1 | U6-13.1:XB9CR1 + EF1A2:CAS9 (RTW1120) | 419 |
| U6-13.1XB9CR2 | U6-13.1:XB9CR2 + EF1A2:CAS9 (RTW1121) | 420 |
| U6-13.1XB5CR1 | U6-13.1:XB5CR1 + EF1A2:CAS9 (RTW1118) | 421 |
| U6-13.1XB5CR2 | U6-13.1:XB5CR2 + EF1 A2:CAS9 (RTW1119) | 422 |
| U6-13.1XB11CR1 | U6-13.1:XB11CR1 + EF1A2:CAS9 (RTW1122) | 423 |
| U6-13.1XB11CR2 | U6-13.1:XB11CR2 + EF1A2:CAS9 (RTW1123) | 424 |

TABLE 17

Guide RNA/Cas9 used in Soybean Stable Transformation for the Complex Trait Locus, CTL-R, on Gm01.

| Experiment | Guide RNA/Cas9 | SEQ ID NOs: |
|---|---|---|
| U6-13.1RA1CR1 | U6-13.1:RA1CR1 + EF1A2:CAS9 (RTW1096) | 425 |
| U6-13.1RA1CR2 | U6-13.1:RA1CR2 + EF1A2:CAS9 (RTW1097) | 426 |
| U6-13.1RA3CR1 | U6-13.1:RA3CR1 + EF1A2:CAS9 (RTW1098) | 427 |
| U6-13.1RA3CR2 | U6-13.1:RA3CR2 + EF1A2:CAS9 (RTW1099) | 428 |

TABLE 17-continued

Guide RNA/Cas9 used in Soybean Stable Transformation for the Complex Trait Locus, CTL-R, on Gm01.

| Experiment | Guide RNA/Cas9 | SEQ ID NOs: |
|---|---|---|
| U6-13.1RA13CR1 | U6-13.1:RA13CR1 + EF1A2:CAS9 (RTW1100) | 429 |
| U6-13.1RA13CR2 | U6-13.1:RA13CR2 + EF1A2:CAS9 (RTW1101) | 430 |
| U6-13.1RC9CR1 | U6-13.1:RC9CR1 + EF1A2:CAS9 (RTW1106) | 431 |
| U6-13.1RC9CR2 | U6-13.1:RC9CR2 + EF1A2:CAS9 (RTW1107) | 432 |
| U6-13.1RC19CR1 | U6-13.1:RC19CR1 + EF1A2:CAS9 (RTW1108) | 433 |
| U6-13.1RC19CR2 | U6-13.1:RC19CR2 + EF1A2:CAS9 (RTW1109) | 434 |
| U6-13.1RC1CR1 | U6-13.1:RC1CR1 + EF1A2:CAS9 (RTW1102) | 435 |
| U6-13.1RC1CR2 | U6-13.1:RC1CR2 + EF1A2:CAS9 (RTW1103) | 436 |
| U6-13.1RB1CR1 | U6-13.1:RB1CR1 + EF1A2:CAS9 (RTW1110) | 437 |
| U6-13.1RB1CR2 | U6-13.1:RB1CR2 + EF1A2:CAS9 (RTW1111) | 438 |
| U6-13.1RB7CR1 | U6-13.1:RB7CR1 + EF1A2:CAS9 (RTW1179) | 439 |
| U6-13.1RB7CR1 | U6-13.1:RB7CR2 + EF1A2:CAS9 (RTW1180) | 440 |

TABLE 18

Guide RNAs used in soybean transformation for the Complex Trait Locus on CTL-D

| Guide RNA name | SEQ ID NO: | Variable targeting domains |
|---|---|---|
| D6-CR1 | 441 | Base 2-20 |
| D6-CR3 | 442 | Base 2-20 |
| DD49-CR2 | 443 | Base 1-20 |
| DD49-CR3 | 444 | Base 2-20 |
| DD43-CR1 | 445 | Base 1-20 |
| DD43-CR2 | 446 | Base 1-20 |
| DD38-CR1 | 447 | Base 2-20 |
| DD38-CR2 | 448 | Base 2-20 |
| DD52-CR1 | 449 | Base 2-20 |
| DD52-CR3 | 450 | Base 2-20 |
| DD20-CR1 | 451 | Base 1-20 |
| DD20-CR2 | 452 | Base 1-20 |
| DD51-CR1 | 453 | Base 2-20 |
| DD51-CR2 | 454 | Base 1-20 |

TABLE 19

Guide RNA used in soybean transformation for the Complex Trait Locus on CTL-X

| Guide RNA name | SEQ ID NO: | Variable targeting domains |
|---|---|---|
| XA9-CR1 | 455 | Base 1-20 |
| XA9-CR2 | 456 | Base 2-20 |
| XA1-CR1 | 457 | Base 2-20 |
| XA1-CR3 | 458 | Base 2-20 |
| XB9-CR1 | 459 | Base 2-20 |
| XB9-CR2 | 460 | Base 2-20 |
| XB5-CR1 | 461 | Base 1-20 |
| XB5-CR2 | 462 | Base 2-20 |
| XB11-CR1 | 463 | Base 2-20 |
| XB11-CR2 | 464 | Base 2-20 |

TABLE 20

Guide RNA used in soybean transformation for the Complex Trait Locus on CTL-R

| Guide RNA name | SEQ ID NO: | Variable targeting domains |
|---|---|---|
| RA1-CR1 | 465 | Base 2-20 |
| RA1-CR2 | 466 | Base 2-20 |
| RA3-CR1 | 467 | Base 1-20 |
| RA3-CR2 | 468 | Base 1-20 |
| RA13-CR1 | 469 | Base 2-20 |
| RA13-CR2 | 470 | Base 2-20 |
| RC9-CR1 | 471 | Base 1-20 |
| RC9-CR2 | 472 | Base 2-20 |
| RC19-CR1 | 473 | Base 1-20 |
| RC19-CR2 | 474 | Base 1-20 |
| RC1-CR1 | 475 | Base 1-20 |
| RC1-CR2 | 476 | Base 2-20 |
| RB1-CR1 | 477 | Base 1-20 |
| RB1-CR2 | 478 | Base 1-20 |
| RB7-CR1 | 479 | Base 2-20 |
| RB7-CR2 | 480 | Base 1-20 |

Example 10

Delivery of the Guide RNA/Cas9 Endonuclease System DNA to Soybean by Stable Transformation The guide RNA/Cas9 DNA constructs and donor DNAs described in Example 9 were co-delivered to an elite (93B86) and/or a non-elite (Jack) soybean genome by the stable transformation procedure described below.

Soybean somatic embryogenic suspension cultures were induced from a DuPont Pioneer proprietary elite cultivar 93B86 or non-elite Jack as follows. Cotyledons (~3 mm in length) were dissected from surface sterilized, immature seeds and were cultured for 6-10 weeks in the light at 26° C. on a Murashige and Skoog (MS) media containing 0.7% agar and supplemented with 10 mg/ml 2,4-D (2,4-Dichlorophenoxyacetic acid). Globular stage somatic embryos, which produced secondary embryos, were then excised and placed into flasks containing liquid MS medium supplemented with 2,4-D (10 mg/ml) and cultured in light on a rotary shaker. After repeated selection for clusters of somatic embryos that multiplied as early, globular staged embryos, the soybean embryogenic suspension cultures were maintained in 35 ml liquid media on a rotary shaker, 150 rpm, at 26° C. with fluorescent lights on a 16:8 hour day/night schedule. Cultures were subcultured every two weeks by inoculating approximately 35 mg of tissue into 35 ml of the same fresh liquid MS medium.

Soybean embryogenic suspension cultures were then transformed by the method of particle gun bombardment using a DuPont Biolistic™ PDS1000/HE instrument (Bio-Rad Laboratories, Hercules, Calif.). To 50 µl of a 60 mg/ml 1.0 mm gold particle suspension were added in order: 30 µl of equal amount (30 ng/µl) plasmid DNA comprising, for example, U6-9.1:DD20CR1+EF1A2:CAS9 and plasmid DNA comprising, for example, (DD20HR1-SAMS:HPT-DD20HR220 µl of 0.1 M spermidine, and 25 µl of 5 M CaCl$_2$. The particle preparation was then agitated for 3 minutes, spun in a centrifuge for 10 seconds and the supernatant removed. The DNA-coated particles were then washed once in 400 µl 100% ethanol and resuspended in 45 µl of 100% ethanol. The DNA/particle suspension was sonicated three times for one second each. Then 5 µl of the DNA-coated gold particles was loaded on each macro carrier disk.

Approximately 300-400 mg of a two-week-old suspension culture was placed in an empty 60×15 mm Petri dish and the residual liquid removed from the tissue with a pipette. For each transformation experiment, approximately 5 to 10 plates of tissue were bombarded. Membrane rupture pressure was set at 1100 psi and the chamber was evacuated to a vacuum of 28 inches mercury. The tissue was placed approximately 3.5 inches away from the retaining screen and bombarded once. Following bombardment, the tissue was divided in half and placed back into liquid media and cultured as described above.

Five to seven days post bombardment, the liquid media was exchanged with fresh media containing 30 mg/ml hygromycin as selection agent. This selective media was refreshed weekly. Seven to eight weeks post bombardment, green, transformed tissue was observed growing from untransformed, necrotic embryogenic clusters. Isolated green tissue was removed and inoculated into individual flasks to generate new, clonally propagated, transformed embryogenic suspension cultures. Each clonally propagated culture was treated as an independent transformation event and subcultured in the same liquid MS media supplemented with 2,4-D (10 mg/ml) and 30 ng/ml hygromycin selection agent to increase mass. The embryogenic suspension cultures were then transferred to agar solid MS media plates without 2,4-D supplement to allow somatic embryos to develop. A sample of each event was collected at this stage for quantitative PCR analysis.

Cotyledon stage somatic embryos were dried-down (by transferring them into an empty small Petri dish that was seated on top of a 10 cm Petri dish containing some agar gel to allow slow dry down) to mimic the last stages of soybean seed development. Dried-down embryos were placed on germination solid media and transgenic soybean plantlets were regenerated. The transgenic plants were then transferred to soil and maintained in growth chambers for seed production. Transgenic events were sampled at somatic embryo stage or T0 leaf stage for molecular analysis.

Example 11

Detection of Site-Specific NHEJ Mediated by the Guide RNA/Cas9 System in Stably Transformed Soybean Genomic DNA was extracted from somatic embryo samples of soybean events generated as described in Examples 9-10 and analyzed by quantitative PCR using a 7500 real time PCR system (Applied Biosystems, Foster City, Calif.) with target site-specific primers and FAM-labeled fluorescence probe to check copy number changes of the double strand break target sites. The qPCR analysis was done in duplex reactions with a syringolide induced protein (SIP) as the endogenous controls and a wild type 93B86 genomic DNA sample that contains one copy of the target site with 2 alleles, as the single copy calibrator. The presence or absence of the guide RNA-Cas9 expression cassette in the transgenic events was also analyzed with the qPCR primer/probes for gRNA/Cas9 and for PinII. The qPCR primers/probes for all the DSB target sites are listed in Table 21.

TABLE 21

Primers/Probes used in qPCR analyses of transgenic soybean events

| Target Site | Primer/Probe Name | Sequences | SEQ ID NOs: |
|---|---|---|---|
| D6-CR1 | D6-F | GAGAACGAGCACACATGTCGAT | 481 |
|  | D6-R | GGTTTAGTTTGGCGTTGGTAAAA | 482 |
|  | D6-T (FAM-MGB) | TGGTTTCAATCTAAGAATG | 483 |
| D6-C R3 | D6-F2 | AACCAAATAAACTCCATTCTCACGAG | 484 |
|  | D6-R | GGTTTAGTTTGGCGTTGGTAAAA | 482 |
|  | D6-T (FAM-MGB) | TGGTTTCAATCTAAGAATG | 483 |
| DD49-CR2 | DD49-F5 | ATCTGCCACTTCATTTACTCAACTTG | 485 |
|  | DD49-R | TGTATGGTGTCAAGTATGAAGTTTATAGTGA | 486 |
|  | DD49-T (FAM-MGB) | AGCTTTCTCTCATCAAAA | 487 |
| DD49-CR3 | DD49-F6 | TACTACAACTCAAAGTCATATTTTTCAGG | 488 |
|  | DD49-R | TGTATGGTGTCAAGTATGAAGTTTATAGTGA | 486 |
|  | DD49-T (FAM-MGB) | AGCTTTCTCTCATCAAAA | 487 |
| DD43-CR1 | DD43-F | TTCTAGAATACCCTCCGTACGTACAA | 489 |
|  | DD43-R | CCCAGATGATTCTCTTTTCACTATTG | 490 |
|  | DD43-T (FAM-MGB) | CAAGGGACTTGTGAGTTGT | 491 |
| DD43-CR2 | DD43-F2 | AAAGAAGAGGCAGACTCCAATTCCTC | 492 |
|  | DD43-R | CCCAGATGATTCTCTTTTCACTATTG | 490 |
|  | DD43-T (FAM-MGB) | CAAGGGACTTGTGAGTTGT | 491 |
| DD38-CR1 | DD38-F4 | TCCATTTTGTCTGTTCTCCATGGATG | 493 |
|  | DD38-R | CACATTGTCCCAGTCACAGAAAG | 494 |
|  | DD38-T (FAM-MGB) | AGATGCGGTAAATTAT | 495 |
| DD38-CR2 | DD38-F5 | ACGTGATGCATCATAGATGCGG | 496 |
|  | DD38-R2 | AGTGTTCTGGCACAAGGTTTACC | 497 |
|  | DD38-T2 (FAM-MGB) | CTCCTCCAGTGGCCAC | 498 |
| DD52-CR1 | DD52-F | TCCCTGAAATTTGTGGTTGGTAA | 499 |
|  | DD52-R2 | TACTAGGAAATGACTGTGCAC | 500 |
|  | DD52-T (FAM-MGB) | CATGGCGTAACCCGTGAT | 501 |
| DD52-CR3 | DD52-F3 | CCCTTTTAAGGAAAAAAACTACGTCAT | 502 |
|  | DD52-R4 | ACATGGCACTGTAACATCAC | 503 |
|  | DD52-T2 (FAM-MGB) | CCCTGAAATTTGTGGTTGG | 504 |
| DD20-CR1&CR2 | DD20-F | ATTCGGAACTGACACACGACAT | 505 |
|  | DD20-R | TCGACATGCAAAGTCAAAAACC | 506 |
|  | DD20-T (FAM-MGB) | ATGGAACGTGACTAAGG | 507 |
| DD51-CR1&CR2 | DD51-F | CGATAACGAGAAGGAGATACATAAGGT | 508 |
|  | DD51-R | TGAACTTCTTCATCCCCATAATTG | 509 |
|  | DD51-T (FAM-MGB) | CGTTGTTGTGTGAGGTAC | 510 |
| RA1-CR1 | RA1-F | CCAAAGGCACGTACGTAAAGG | 511 |
|  | RA1-R | TTGCAATTGTGCACTGTTTTTTT | 512 |
|  | RA1-T (FAM-MGB) | AGCACATGTTCTAATGAA | 513 |
| RA1-CR2 | RA1-F2 | CACACACAAAAATTACCAAAGGC | 514 |
|  | RA1-R | TTGCAATTGTGCACTGTTTTTTT | 512 |
|  | RA1-T (FAM-M GB) | AGCACATGTTCTAATGAA | 513 |
| RA3-CR1&CR2 | RA3-F | TTTGGTGTCCACAGAATATTCGA | 515 |
|  | RA3-R | CTTTAATGCATTGTTTTGGATAGTCATC | 516 |
|  | RA3-T (FAM-M GB) | AGATGTAGTACCACACTAACTA | 517 |
| RA13-CR1&CR2 | RA13-F | CTGCACTCACCGGCAAAGT | 518 |
|  | RA13-R | ACCTCTCTATCCCTTCTTCTTCGT | 519 |
|  | RA13-T (FAM-MGB) | CTCTCCAATAAAGAGAATAGA | 520 |

TABLE 21-continued

Primers/Probes used in qPCR analyses of transgenic soybean events

| Target Site | Primer/Probe Name | Sequences | SEQ ID NOs: |
|---|---|---|---|
| RC9-CR1&CR2 | RC9-F | AAGTGAGATGTGGTGCGTACGTAGG | 521 |
|  | RC9-R | GGTTTGTGGCTATAACTTGAGAGAATG | 522 |
|  | RC9-T (FAM-MGB) | ATTCTTAAAAAAGATCGAAGGAC | 523 |
| RC19-CR1&CR2 | RC19-F | GAATTCAGGTCGGATCCAAGAT | 524 |
|  | RC19-R | GTGCTATGGTGCTCGTGTAAGG | 525 |
|  | RC19-T (FAM-MGB) | TGAGTGATCGGAGTTTC | 526 |
| RC1-CR1&CR2 | RC-F | CAACACCAACACCCTTTCTAACAG | 527 |
|  | RC1-R2 | AAGGCCCCCCGTGCAGG | 528 |
|  | RC1-T (FAM-MGB) | AGCATCAAAATTGGC | 529 |
| RB1-CR1 | RB1-F | CCCCGGTTTCGTACAACAATGGCA | 530 |
|  | RB1-R | CATCCTCGCTACTCTCTAAGACAATG | 531 |
|  | RB1-T (FAM-MGB) | CTTGATCTCAATTCCG | 532 |
| RB1-CR2 | RB1-F2 | AATCTATTATCCCCCGGTTTCG | 533 |
|  | RB1-R | CATCCTCGCTACTCTCTAAGACAATG | 531 |
|  | RB1-T (FAM-MGB) | CTTGATCTCAATTCCG | 532 |
| RB7-CR1 | RB7-F1 | CCCTATATGACTAGGAAAATTCAGG | 534 |
|  | RB7-R | GCTACATTTGGTTGGGTCACTTG | 535 |
|  | RB7-T (FAM-MGB) | TCGGTCCCTATGCCTAT | 536 |
| RB7-CR2 | RB7-F2 | CAGGTACGGACCACCACTAATGG | 537 |
|  | RB7-R | GCTACATTTGGTTGGGTCACTTG | 535 |
|  | RB7-T (FAM-MGB) | TCGGTCCCTATGCCTAT | 536 |
| XA9-CR1&CR2 | XA9-F | GAAACTTTTGTGAGCAAGTAGGTAGCT | 538 |
|  | XA9-R | ATGGCAAGAACAAGACCAAAGAC | 539 |
|  | XA9-T (FAM-MGB) | AGAGTCAAGACCAATTAATGA | 540 |
| XA1-CR1 | XA1-F2 | ATGAAGTGTGAGTGGGCAAGTG | 541 |
|  | XA1-R | GTCCTCACCGCCATGCACT | 542 |
|  | XA1-T2 (FAM-MGB) | CGTTTCTTCCACGATTAT | 543 |
| XA1-CR3 | XA1-F | GCGTTTCTTCCACGATTATGTG | 544 |
|  | XA1-R | GTCCTCACCGCCATGCACT | 542 |
|  | XA1-T (FAM-MGB) | TGGCCGCAACGACAA | 545 |
| XB9-CR1&CR2 | XB9-F | ATTATTACACAATTTAGTTGCCTGACGG | 546 |
|  | XB9-R | TGTGGTGATAGATCCCCTTTTATAGG | 547 |
|  | XB9-T (FAM-MGB) | TTTTTTTCATCCAACCTTGTCA | 548 |
| XB5-CR1 | XB5-F1 | GGTTCAGGTTGTTGTACGACATG | 549 |
|  | XB5-R | GTTGAATGGTATGATGTTACTGAGCTTAT | 550 |
|  | XB5-T (FAM-MGB) | TTGTGGATACGGTAGTTGTG | 551 |
| XB5-CR2 | XB5-F2 | TTATTGTATGAAGACATGAATCATTGAGG | 552 |
|  | XB5-R | GTTGAATGGTATGATGTTACTGAGCTTAT | 550 |
|  | XB5-T (FAM-MGB) | TTGTGGATACGGTAGTTGTG | 551 |
| XB11-CR1 | XB11-F | GTGCCATTTGCCCATTATGTATG | 553 |
|  | XB11-R | CTTGTTGGTACTTCATGCTAGTAGATTTC | 554 |
|  | XB11-T (FAM-MGB) | TGCAAGTTGGGTTATGAAATTGGT | 555 |
| XB11-CR2 | XB11-F3 | CATTATGTATGATGCAAGTTGGG | 556 |
|  | XB11-R2 | CATGGGTTATGATCCTCAAAGTCA | 557 |
|  | XB11-T2 (FAM-MGB) | AGCTACGTGATCTGATG | 558 |
| gRNA/CAS9 | Cas9-F | CCTTCTTCCACCGCCTTGA | 559 |
|  | Cas9-R | TGGGTGTCTCTCGTGCTTTTT | 560 |
|  | Cas9-T (FAM-MGB) | AATCATTCCTGGTGGAGGA | 561 |

TABLE 21-continued

Primers/Probes used in qPCR analyses of transgenic soybean events

| Target Site | Primer/Probe Name | Sequences | SEQ ID NOs: |
|---|---|---|---|
| pINII | pINII-99F | TGATGCCCACATTATAGTGATTAGC | 562 |
| | pINII-13R | CATCTTCTGGATTGGCCAACTT | 563 |
| | pINII-69T (FAM-MGB) | ACTATGTGTGCATCCTT | 564 |
| Donor DNA | Sams-76F | AGGCTTGTTGTGCAGTTTTTGA | 565 |
| | FRT1-41R | GCGGTGAGTTCAGGCTTTTTC | 566 |
| | FRT1-63T | TGGACTAGTGGAAGTTCCTATA | 567 |
| SIP | SIP-130F | TTCAAGTTGGGCTTTTTCAGAAG | 568 |
| | SIP-198R | TCTCCTTGGTGCTCTCATCACA | 569 |
| | SIP-170T (VIC-MGB) | CTGCAGCAGAACCAA | 570 |

The endogenous control probe SIP-T was labeled with VIC and the gene-specific probes for all the target sites were labeled with FAM for the simultaneous detection of both fluorescent probes (Applied Biosystems). PCR reaction data were captured and analyzed using the sequence detection software provided with the 7500 real time PCR system and the gene copy numbers were calculated using the relative quantification methodology (Applied Biosystems).

Since the wild type Jack or 93B86 genomic DNA with two alleles of the double strand break target site was used as the single copy calibrator, events without any change of the target site would be detected as one copy herein termed Wt-Homo (qPCR value >=0.7), events with one allele changed, which is no longer detectible by the target site-specific qPCR, would be detected as half copy herein termed NHEJ-Hemi (qPCR value between 0.1 and 0.7), while events with both alleles changed would be detected as null herein termed NHEJ-Null (qPCR value=<0.1). The wide range of the qPCR values suggested that most of the events contained mixed mutant and wild type sequences of the target site. As shown in Table 23, the Double Strand Break (DSB) efficiency varied from site to site and from one guide RNA/Cas9 endonuclease system to another on the same target. For example, the D6 CR1 provided 19% NHEJ-Hemi and 57% NHEJ-Null (a very efficient DSB reagent), in contrast, the D6 CR3 only provided 22% NHEJ-Hemi and 3% NHEJ-Null in Jack genotype. The D6 CR3 also exhibited some toxicity as was evidence by the low event generation number (37 events from D6 CR3 vs 168 events from D6 CR1).

DD49 CR2 can be a better DSB reagent than DD49 CR3 as is evidenced by the higher NHEJ-Heni and Insertion frequency (Table 22). The two guide RNA/Cas9 systems for the other sites (DD43, DD38, DD52, DD20, DD51) all provided good double strand breaks (DSB) efficiency. One set of CR for each target was also tested in elite 93B86 genotype as shown in Table 23. The DSB efficiency is very similar to the data from Jack.

Both NHEJ-Hemi and NHEJ-Null were detected in Jack or 93B86 genotypes. The differences between NHEJ frequencies were likely caused by variations between transformation experiments. NHEJ mutations mediated by the guide RNA/Cas9 system at the specific Cas9 target sites were confirmed by PCR/topo cloning/sequencing.

TABLE 22

Target Site Mutations and Site Specific Gene Integration Induced by the Guide RNA/Cas9 system on a genomic window referred to as CTL-D on Gm04 in soybean (Jack). Numbers indicate no. of events (numbers in parentheses are %).

| Project | Total event | Wt-Homo (%) | NHEJ-Hemi (%) | NHEJ-Null (%) | Insertion Frequency (%) |
|---|---|---|---|---|---|
| U6-13.1D6CR1 | 168 | 40 (24%) | 32 (19%) | 96 (57%) | 1 (0.6%) |
| U6-13.1D6CR3 | 37 | 28 (76%) | 8 (22%) | 1 (3%) | 0 |
| U6-13.1DD49CR2 | 121 | 66 (55%) | 34 (28%) | 21 (17%) | 2 (1.6%) |
| U6-13.1DD49CR3 | 136 | 113 (83%) | 23 (17%) | 0 (0%) | 0 |
| U6-9.1 DD43 CR1 | 141 | 84 (60%) | 27 (19%) | 30 (21%) | 1 (0.7%) |
| U6-13.1 DD43 CR1 | 152 | 67 (44%) | 56 (37%) | 29 (18%) | 0 |
| U6-13.1 DD43 CR2 | 156 | 38 (24%) | 64 (41%) | 54 (35%) | 1 (0.6%) |
| U6-13.1 DD38 CR1 | 143 | 52 (36%) | 79 (55%) | 12 (8%) | 2 (1.4%) |
| U6-13.1 DD38 CR2 | 110 | 34 (31%) | 38 (34%) | 38 (34%) | 2 (1.8%) |
| U6-13.1 DD52 CR1 | 177 | 108 (61%) | 45 (25%) | 24 (14%) | 1 (0.6%) |
| U6-13.1 DD52 CR3 | 150 | 39 (26%) | 20 (13%) | 91 (61%) | 1 (0.7%) |
| U6-9.1 DD20 CR1 | 114 | 76 (67%) | 28 (25%) | 10 (9%) | 0 |
| U6-13.1 DD20 CR1 | 118 | 58 (49%) | 37 (31%) | 23 (20%) | 0 |
| U6-13.1 DD20 CR2 | 111 | 43 (39%) | 29 (26%) | 39 (35%) | 0 |
| U6-13.1 DD51 CR1 | 323 | 67 (21%) | 102 (32%) | 154 (48%) | 4 (1.2%) |
| U6-13.1 DD51 CR2 | 156 | 62 (40%) | 46 (29%) | 48 (31%) | 3 (1.9%) |

TABLE 23

Target Site Mutations and Site Specific Gene Integration Induced by the Guide RNA/Cas9 system on CTL-D on Gm04 in elite soybean germplasm 93B86. Numbers indicate no. of events (numbers in parentheses are % of the total analyzed events).

| Project | Total event | Wt-Homo (%) | NHEJ-Hemi (%) | NHEJ-Null (%) | Insertion frequency (%) |
|---|---|---|---|---|---|
| U6-13.1D6CR1 | 146 | 34 (23%) | 28 (19%) | 84 (58%) | 0 (0%) |
| U6-13.1DD49CR2 | 90 | 12 (13%) | 38 (42%) | 40 (44%) | In progress |
| U6-9.1DD43CR1 | 263 | 53 (20%) | 88 (34%) | 122 (46%) | 10 (3.8%) |
| U6-13.1DD38CR1 | 134 | 29 (22%) | 90 (67%) | 15 (11%) | 2 (1.5%) |
| U6-13.1DD52CR1 | 162 | 28 (17%) | 84 (52%) | 50 (31%) | 0 (0%) |
| U6-9.1DD20CR1 | 239 | 85 (36%) | 77 (32%) | 77 (32%) | 11 (4.6%) |
| U6-13.1DD51CR1 | 148 | 13 (9%) | 38 (26%) | 97 (66%) | In progress |

Example 12

Introducing Transgenic SSI Target Sites within a Soybean Genomic Window Using the Guide RNA/Cas9 Endonuclease System In order to develop a Complex Trait Locus in a genomic window of the soybean genome, a method was developed to introduce transgenic SSI (site specific Integration) target sites in close proximity to a soybean genomic locus of interest using the guide RNA/Cas9 endonuclease system. First, a genomic window was identified into which multiple SSI target sites in close proximity can be introduced (FIG. 2A, FIGS. 4-7, and FIGS. 9-11, Example 8). The DNA sequence of the genomic window was than evaluated for the presence of any double strand break target sites, specifically for the presence of any Cas9 endonuclease target sites. Any 23 bp genomic DNA sequence following the pattern N(20) NGG can be selected as a target site for the guide RNA/Cas9 endonuclease system. A guide RNA and a Cas endonuclease can be introduced either through the use of expression cassettes (as described in Example 9 and Example 10), or can directly be introduced into a soybean cell comprising any one of the Cas9 endonuclease target sites, wherein said guide RNA and Cas endonuclease are capable of forming a complex that enables the Cas endonuclease to introduce a double strand break at the Cas endonuclease target site. These soybean cells were provided with a donor DNA comprising a transgenic SSI target site comprising two recombination sites (such as but not limited to FRT1, FRT87, FRT6, FIG. 2B) flanked by a first and second region of homology (FIG. 2B). Optionally, the donor DNA can contain a polynucleotide of interest between the two FRT sites. These soybean cells were then evaluated for the presence of NHEJ indicating that the guide RNA/Cas endonuclease system was functional and capable of introducing a double strand break (Example 11). Upon cleavage of the Cas9 endonuclease target site, the transgenic SSI target site was introduced into the DSB target site resulting into a modified double strand break target site (aDSB, FIG. 2D) comprising a transgenic SSI target site.

The integration of the transgenic SSI sites via guide RNA/Cas9 system mediated DNA homologous recombination was determined by border-specific PCR analysis at both possible transgene genomic DNA junctions at different DSB target sites using two primer pairs. For Example, the 5' end borders of DD38CR1 events were amplified as a 1241 bp PCR amplicon by PCR with while the 3' borders of the same events were amplified as a 1210 bp PCR amplicon. Any events with both the 5' border and 3' border-specific bands amplified were considered as site-specific integration events through homologous recombination containing the transgene from the donor DNA. All the border-specific PCR fragments were sequenced and were all confirmed to be recombined sequences as expected from homologous recombination. Border PCR assays for other DSB sites were carried out with the same approach with the specific border primers. On average, gene integration through the guide RNA/Cas9 mediated homologous recombination occurred at 0.6% to 4% of the total transgenic events (Insertion frequency, Table 22 and Table 23) in either Jack or 93B86 genotype.

The Introduction of the FRT1 and FRT87 sites in these DSB sites provided the ability to use the FLP/FRT technology to perform gene stacking by the SSI technology and develop a complex trait locus within a genomic window.

Example 13

Introduction of Trait Genes Directly into Double Strand Break Target Sites Using a Guide RNA/Cas Endonuclease Systems in Plant Genomes Described herein (Examples 1-12) are methods for introducing transgenic target sites for SSI (comprising recombination sites such as but not limited to FRT1, FRT87, FRT6) into a double-strand break target site (such as a Cas9 endonuclease target site) using a guide RNA/Cas9 system and allowing for the use of FLP/FRT technology to perform gene integration and gene stacking by the SSI technology and develop a complex trait loci within a genomic window. One skilled in the art understands that transgenic SSI target sites can also be introduced into DSB sites by other double strand break agents such as but not limited to Zinc fingers, meganucleases, TALENS etc. The Introduction of the FRT1 and FRT87 (or FRT6) sites in these DSB sites enables the use of the FLP/FRT technology to perform gene stacking by the SSI technology.

Another method of specific gene integration is to introduce one or more trait (or gene expression cassettes) directly into a DSB site of a plant genome, such as Cas9 endonuclease target site, as illustrated in FIG. 3A-3C and described below.

Plant cells can be provided with a donor DNA containing at least one polynucleotide of interest (such as, but not limited to, a trait gene cassette) flanked by flanked by a first and second region of homology (HR1, HR2, respectively, FIG. 3B) to a first and second DNA sequence (DNA1, DNA2, respectively, FIG. 3A) located in a genomic window (FIG. 3A). The donor DNA can contain one or more trait gene cassette(s).

These plant cells are further provided with a guide RNA and Cas endonuclease, either directly or via expression cassettes such as a plant codon optimized Cas9 endonuclease expression cassette (such as, but not limited to, a soybean codon optimized Cas9 endonuclease expression cassette or a maize codon optimized Cas9 endonuclease expression cassette) and a guide RNA expression cassette, located on different plasmids or linked on the same plasmid (as illustrated in FIG. 2C).

The plant cells are then evaluated for the alteration of the DSB target site (such as the alteration of a Cas9 endonuclease target site) indicating that the guide RNA/Cas endonuclease system was functional and capable of introducing a double strand break and enabling trait integration at these pre-defined double strand break target sites by homologous recombination (FIG. 3C). The resulting plant cells For direct trait gene integration into a maize cell, the donor DNA can contain nucleotide sequences like 45HR1-Selectable Marker-Trait Gene Expression Cassette-45HR2 or it can contain trait genes flanked by homologous regions surrounding other maize target sites described herein. For direct trait gene integration into a soybean cell, the donor DNA can contain DD38 HR1-Promoter::Selectable marker-Trait Gene Expression Cassette-DD38 HR2, or it can contain trait genes flanked by homologous regions surrounding other soybean target sites described herein.

Example 14

Creation of Complex Trait Loci (CTL) in Maize and Soybean

As discussed herein, four genomic windows were identified for the creation of Complex Trait Loci (CTL) in a maize genome. CTL1 on maize chromosome 1 (Table 1, FIG. 4), CTL2 on maize chromosome 1 (Table 2, FIG. 5), CTL3 on maize chromosome 3 (Table 3, FIG. 6) and CTL4 on maize chromosome 10 (Table 4, FIG. 7). Also, Three genomic windows were selected for the creation of complex trait loci in a soybean genome, CTL-D on soybean chromosome 4, Gm04 (Table 12, FIG. 9), CTL-X on soybean chromosome 6, Gm06 (Table 13, FIG. 10) and CTL-R on soybean chromosome 1, Gm01 (Table 14, FIG. 11).

Multiple transgenic SSI target sites were introduced into each of said genomic windows, in close proximity to a maize or soybean genomic locus of interest (plus or minus 5 cM), using the guide RNA/Cas9 endonuclease system described herein (Example 6, Example 7-13). Furthermore, trait genes can also be directly introduced into double strand break target sites (such as Cas9 endonuclease sites) located within said genomic windows, using a guide RNA/Cas endonuclease system (as described in Example 13). Plants comprising one or multiple of these introduced transgenic SSI target sites, and/or introduced trait genes, can be crossed and progeny can be screened for the presence of the stacked transgenic SSI target sites and/or integrated trait genes. For example, a first plant comprising three transgenic SSI target sites A, B, C in a genomic window, can be crossed with a second plant comprising three transgenic SSI target sites D, E, F in the same genomic window, and progeny can be identified that comprises the sic transgenic SSI target sites A, B, C, D, E, F. This process can be repeated again with plants having other target sites in the same genomic window to further create the more target sites in that genomic window.

Different trait genes can be specifically integrated into the transgenic SSI target sites or into the different DSB sites in wild type elite genotype, such as maize GR2HT or maize HC69, soybean 93B86 and can be stacked together by breeding at later generations (as described in U.S. patent application Ser. No. 13/427,138, filed on Mar. 22, 2013 and U.S. patent application Ser. No. 13/748,704, filed Jan. 24, 2014, both are incorporated by reference herein). The trait gene integration can be executed either by SSI technology with the FRT1/FRT87 (or FRT6) sites or by direct trait gene integration by double strand break technology.

The resulting progeny plants can be screened for the presence of the stacked trait genes within the same genomic locus thereby creating a Complex Trait Locus.

SEQUENCE LISTING (580 sequences)

SEQ ID NO: 1 - DNA, 201 bp, Zea mays
tgtgttccaaagaaattgctagtgtacgcatccaagtactctcacgagtttgaagagtctcgtggatttggatggacatatgagactgatccgaagcatgattggagcactctcatagccaataaaaatacagagctgcagcgcctggttggcatttacaggaatattttaaacaatgcaggagtcactctgatcgaaggt

SEQ ID NO: 2 - DNA, 201 bp, Zea mays
gttattacaataactggtgccaagtttctcattttgtttgtcgctctaacctttggtgcttttgcaacaatttcgtgctaggttgatgagtattcacgtacctcagttgattccatttgggctgttggagatgttaccaatagggtcaacctgacaccagttgcactgatggagggtggggcatttgcgaaaactgtcttt

SEQ ID NO: 3 - DNA, 22 bp, Zea mays
gctgtggacgtggggtgctggg

SEQ ID NO: 4 - DNA, 22 bp, Zea mays
gaaccacactgaacaacaacgg

SEQ ID NO: 5 - DNA, 24 bp, Zea mays
gccgcctaggtagaaatgtgaagg

SEQ ID NO: 6 - DNA, 201 bp, Zea mays
caagtaatataacataatataagcatttggataaacatcggaagtcgcattcttagaacagaagatgagccccctatatgactatcgagaccacagcatcatttttacaggaattatgctacttcagaagtaaagaaaacggacaagctcctgggcacattatcagaagcacatggaagtcattttactaatttgaccaca

SEQ ID NO: 7 - DNA, 24 bp, Zea mays
gactaaatgtaattgctacttggg

SEQ ID NO: 8 - DNA, 25 bp, Zea mays
gcaggacagggaggtaaaaggatgg

SEQ ID NO: 9 - DNA, 23 bp, Zea mays
gagggaggcctgtgacgcattgg

SEQ ID NO: 10 - DNA, 23 bp, Zea mays
gaccgttgctgatggatcaatgg

SEQ ID NO: 11 - DNA, 22 bp, Zea mays
gttccaacgatgacaagactgg

SEQ ID NO: 12 - DNA, 201 bp, Zea mays
catggaagacgacccgcttcggcagctcgtccgcgcgcacggcctccaccggcgtccgcggcaccaggtaggcctcctgcatatatacgtactcaggaaaaatcatctcagattctgcatatataccccaaaccaaacggggccttaattctacgcatgccaatctttcaggtagtacctaaaatgcaactataatctaat

SEQ ID NO: 13 - DNA, 23 bp, Zea mays
gcacaataatggtcctccttagg

SEQ ID NO: 14 - DNA, 22 bp, Zea mays
gatgatgacaatgaccacatgg

SEQ ID NO: 15 - DNA, 23 bp, Zea mays
gtgccagaggcagcatcgaccgg

SEQ ID NO: 16 - DNA, 23 bp, Zea mays
gctcttgggctcaagagagtagg

SEQ ID NO: 17 - DNA, 24 bp, Zea mays
gagacatcctcattctagagcggg

SEQ ID NO: 18 - DNA, 25 bp, Zea mays
gcctcagtcatagttccactctcgg

SEQ ID NO: 19 - DNA, 23 bp, Zea mays
gagcttgttatcagatgcagagg

SEQ ID NO: 20 - DNA, 201 bp, Zea mays
gtcgtcgccgtcgtgtcccgcccggcgatcacgaagttgagcaccacgtcccggaggctcttatcgtccccgaagccgccgccgtcgtcgccggcctcgcccagctcgatgaaccgtgacaggatgtcgtgcttcatctgcccattttaatttgccctcacaagtcacatggatatataatcaatcaggatcaggtccatc

SEQ ID NO: 21 - DNA, 22 bp, Zea mays
gtcctcgtacaggagggcgcgg

SEQ ID NO: 22 - DNA, 22 bp, Zea mays
gagctatacctagtgataaagg

SEQ ID NO: 23 - DNA, 27 bp, Zea mays
gaatatccctttctacgaaagaattgg

SEQ ID NO: 24 - DNA, 201 bp, Zea mays
aaacctgaaaactcttgcgagagctttgagtaggtcaagaactcagcgagcttgtatgcatgattgcaggacatgcaacaaagcggcggcagcggcagcggtacgactgatccgaaagggcaagagaacaacgttcaggactccacaggctcgcctccgcagcaggaggtcgcggacaccgaagactcgtcggcagacaaa

SEQ ID NO: 25 - DNA, 25 bp, Zea mays
gtcaatggagaattctctgttaagg

SEQ ID NO: 26 - DNA, 21 bp, Zea mays
gtacgtaacgtgcagtactgg

SEQ ID NO: 27 - DNA, 24 bp, Zea mays
gtgctccctgctactgcgaaccgg

SEQ ID NO: 28 - DNA, 21 bp, Zea mays
ggtgcaggcaggagaatttgg

SEQ ID NO: 29 - DNA, 201 bp, Zea mays
atcggtacaataacttaccacagccaccagaaacgcgcctttcaggtttgcgcaggcttcacagcacgcgtttgtcataaggaacggaaaccacctgtgcatgtgatagcaccagaaattcagaacgcgcccgtgttaagtaaaaccagttccagaataatttaaaaaaaaacaggtagagttcgtgtgggagcggtgggc

SEQ ID NO: 30 - DNA, 25 bp, Zea mays
gatcgatacacatacacttgcacgg

SEQ ID NO: 31 - DNA, 27 bp, Zea mays
gcataataagtgaggagataatcttgg

SEQ ID NO: 32 - DNA, 22 bp, Zea mays
gcaatttgtatcttgcgcacgg

SEQ ID NO: 33 - DNA, 23 bp, Zea mays
gaggaaacacagacaagttgggg

SEQ ID NO: 34 - DNA, 26 bp, Zea mays
gtacttgctcactgtctaaatactgg

SEQ ID NO: 35 - DNA, 201 bp, Zea mays
atccaagtgcccaagatgccgcctgatgaatgcttcaagtgctccgacaaggaatcgcttgcggtgggcactgagctgcttgtgttcgggatggcgcgtatcgtcttccgatacagcatcctgaccaactcatggagcagggctgatccgatgaactctccgcggtgcctgttcgggtcaacgagtgtcggcgggaaggcc

SEQ ID NO: 36 - DNA, 24 bp, Zea mays
gcataatgaggatcgaggatgagg

SEQ ID NO: 37 - DNA, 21 bp, Zea mays
gctcgtgttggagatacaggg

SEQ ID NO: 38 - DNA, 22 bp, Zea mays
gtgagcctgagcccatgcatgg

SEQ ID NO: 39 - DNA, 23 bp, Zea mays
gttgatcaaagcgatggcacagg

SEQ ID NO: 40 - DNA, 201 bp, Zea mays
aggtgtcaaagcgagacgatctcgatgctagtctcagaaatggcagttgctgacacagcgtttgcgctactcgccatcgtcgtcgtccacaggttggccatcaccggcgtcgccattagatgctggaaggggttcacaggagcagcgatgctcatctcaccctctagcatcttcaccaccgcacccatgggcggcctcgct

SEQ ID NO: 41 - DNA, 201 bp, Zea mays
tagtgtcttgcctatgcagctaagagtacaggtctaaagcacaagcaataaatacaacagtacataataaaagtgtctggtgtaccttagataaccatgacaagaccatggaaaaaaagactgatgcaagggtgtcactaacctcatatgtcatattatcaggctcaatgttatcttgccaaacaacctacaaacataata

SEQ ID NO: 42 - DNA, 201 bp, Zea mays
ctagcttgatgtggattctctgttttttttaactcgagtgcaaccaaaataataataaaaatgctctgttgttgcagcttggagctctggtactacactgcggtgctcatccttgtagggttcctgaagaacgcgcggcttcagattgacgtcatgtccatctggtaactaatttttatgaactaagcagcccatgcatca

SEQ ID NO: 43 - DNA, 23 bp, Zea mays
gcagttggatatgtctagccggg

SEQ ID NO: 44 - DNA, 25 bp, Zea mays
gacacgcactgcaccccgtcgtcgg

SEQ ID NO: 45 - DNA, 23 bp, Zea mays
gctagctgagaaaatgtgcccgg

SEQ ID NO: 46 - DNA, 22 bp, Zea mays
gcacagcttacatcagctttgg

SEQ ID NO: 47 - DNA, 25 bp, Zea mays
gcatgtacatgcaatgcaatcacgg

SEQ ID NO: 48 - DNA, 201 bp, Zea mays
ggtactaaggtaggatataatcaaatcgaacgcaaagatcacaaagaaacagtctaagggtttcaaagcgttggaccaaggcatcagactggtggagtacatgcatcagattacacaatagagcaaaccctagcaaaatttcaattgggctcagggaagaagcgagtttgggtcacacaattgtggaggctccaaccatcc

SEQ ID NO: 49 - DNA, 22 bp, Zea mays
gccggggacctgtacaggaagg

SEQ ID NO: 50 - DNA, 25 bp, Zea mays
gacctgtacaggaaggcaacgatgg

SEQ ID NO: 51 - DNA, 25 bp, Zea mays
gaactcttgcacggccaatccatgg

SEQ ID NO: 52 - DNA, 26 bp, Zea mays
gaactcgaggaagacggttctagcgg

SEQ ID NO: 53 - DNA, 201 bp, Zea mays
gctaaatgagttagtttttttgggtgggggaggggctcttgcattattgctagaaatatttttaaaaaaaaaacctcatgagctccaccacccgtccgcccaggacgggaagcccgaaaccgcgcgcggccgcagcaggcccgccggcgcggcggcgccggccattctctgcagctgttgggtgctggtagctgcagcgtc

SEQ ID NO: 54 - DNA, 22 bp, Zea mays
gcagcggaactgtgagtgacgg

SEQ ID NO: 55 - DNA, 23 bp, Zea mays
gtacgtgtgcgctatcaaagtgg

SEQ ID NO: 56 - DNA, 23 bp, Zea mays
gccgtgcgacacacgtactgcgg

SEQ ID NO: 57 - DNA, 24 bp, Zea mays
gacacacgtactgcggcgtcatgg

SEQ ID NO: 58 - DNA, 25 bp, Zea mays
gtcgccacacgtcgtccgagttcgg

SEQ ID NO: 59 - DNA, 201 bp, Zea mays
caatggagaaaaaggggcctcaggccctcacagcaactgagctgaatgctgccgtgtacagatacctccaggaatcaggtttcagaaccataatctaaccctgtcacaattcggttagatattagcattacatgtttgtcggttctttcttggggaaattatgatcattgtgttgttaggggtctacgtaatgaccagaat

SEQ ID NO: 60 - DNA, 25 bp, Zea mays
gaccacggccagctgtagcgctagg

SEQ ID NO: 61 - DNA, 201 bp, Zea mays
ttctttttttttcttatgtccgtctgcctgcaaatgtcccttgtcttcttttggtgtgcttattatacgcgcatataacatgttgtcagttcttcagcgtcctcaagtaatggcaggagctgaataatccacacactagcatgtgcagagacaatgctaatctgttccatctgctgctacttccgacagggggcgacgaga

SEQ ID NO: 62 - DNA, 201 bp, Zea mays
ctgggtgaagaagtaaagatcagccgagaatgaggtcaacccagttgaatccaatggagctgtggtctcggttaagaagacagtatatacaacactaatcaccaaatcttagtcgccgcttgcggccgccgccatcactagccaagccatcgtccctggcgcgcggtcgcgtccaggcttccattccaggttactaggtgt

SEQ ID NO: 63 - DNA, 22 bp, Zea mays
gcacggtgtagggacgtgtggg

SEQ ID NO: 64 - DNA, 21 bp, Zea mays
gaaacagtcaatactttgagg

SEQ ID NO: 65 - DNA, 22 bp, Zea mays
gttgggctacatgaaccaaggg

SEQ ID NO: 66 - DNA, 22 bp, Zea mays
gccagcccggacctcatcgtgg

SEQ ID NO: 67 - DNA, 201 bp, Zea mays
ccttagcaaggtgctgtaactgactacaacagcgatcttcctgaggaaatgtgcaaggggctgcccataggtgtgagggaacgcatggctgatcacatgagcgcatgacaggtcagctgcaattgcggcgtcaccatactccaccctaacagtagtgccctgaataagtggataaaataacaaatgaaacataatagaatt

SEQ ID NO: 68 - DNA, 21 bp, Zea mays
gaaagggatgctaccgacagg

SEQ ID NO: 69 - DNA, 25 bp, Zea mays
gtaataagtaataaccatatgcagg

SEQ ID NO: 70 - DNA, 20 bp, Zea mays
ggttatcgagggactagtgg

SEQ ID NO: 71 - DNA, 21 bp, Zea mays
gagcatcaagttcacttaggg

SEQ ID NO: 72 - DNA, 21 bp, Zea mays
gcagtagcgttcaatccgagg

SEQ ID NO: 73 - DNA, 201 bp, Zea mays
gcggggcaccgggggccggaaatcggtggcgccgccggccgctccgtcgtggggagattctacgccgttgtcagacacactgtgggttgtcgccgattgagtaactgtggatcctcgtttggacggtccggattagaccctgtaggtaccccttcgcagcattaaggagctggccgttgatcacccatcgtacggctaggg

SEQ ID NO: 74 - DNA, 22 bp, Zea mays
gttagcattatgacaagacagg

SEQ ID NO: 75 - DNA, 20 bp, Zea mays
gatctgcctattgcgctggg

SEQ ID NO: 76 - DNA, 26 bp, Zea mays
gtcaacaaattagtgaggacgtcggg

SEQ ID NO: 77 - DNA, 20 bp, Zea mays
gttcctgggctaccggttgg

SEQ ID NO: 78 - DNA, 21 bp, Zea mays
gccgtcgtcgctcgatcgtgg

SEQ ID NO: 79 - DNA, 201 bp, Zea mays
ctcgtttaggttcagttgagatctcacctcaggtagacaaacgcgtcaccagcaatcagcttctttgatgtgacaaacgtgctccatccagtagtcagaaggtgccgacggggttggcctagagaacaaggagttgcagaattaagcaccataagttgcataaaggtagagaattcagtggagatggagactgtactgtac

SEQ ID NO: 80 - DNA, 20 bp, Zea mays
gcattatttcggatcgtcgg

SEQ ID NO: 81 - DNA, 23 bp, Zea mays
gccagtagtctaagcaaagatgg

SEQ ID NO: 82 - DNA, 20 bp, Zea mays
gatattgacgactcgatcgg

SEQ ID NO: 83 - DNA, 22 bp, Zea mays
gttgctcttagactcgtatcgg

SEQ ID NO: 84 - DNA, 201 bp, Zea mays
gacactcccgctttaaatttaagtttttcgcgaaaatcttgaataagactagccatttaaacttggtaaaaaaatcatgtcagctatattggagtcgattctaccgatatcgaccatgatattggatgaaccggtccataccgtctgactttagttacataatttttttttattggtctacacgtacttcacgtcaactag

SEQ ID NO: 85 - DNA, 201 bp, Zea mays
gagtgttagagtatatggattaggtccatgaggtccgtgtatgaatactgtatagcaaccctctctagggctggcccaataatgaattccactctctccaacaagcttatcatagaaatccaacacagcagcatgcttctcatcttggtcggtgatcacccgatcaccaacctgcaactttgcaataaaattccctttctt

SEQ ID NO: 86 - DNA, 201 bp, Zea mays
ctgcaccgccaaaatccgtggcaccagcactggcctagaagccgacaccaaaccccagatcaagcttcagaagaagaattggctgcgaaaggggtgagcggcgaatgctataactgcacgaagaagtacactgctgaccataattgtgcagcgaaaggggtcttctttctggagttagatgataaagaggaagaggaggag

SEQ ID NO: 87 - DNA, 20 bp, Zea mays
ggctagaccgtgtacctagg

SEQ ID NO: 88 - DNA, 22 bp, Zea mays
ggctcaaatcacaccgtaatgg

SEQ ID NO: 89 - DNA, 20 bp, Zea mays
ggtacatctcgaaatgcagg

SEQ ID NO: 90 - DNA, 23 bp, Zea mays
gactcagtggggaaatgttctgg

SEQ ID NO: 91 - DNA, 201 bp, Zea mays
catacaaacaaaagctccacaagtctctgaaacttatatctccacaaccacagccaattaaacacttcaacaaatccccaaaatgtaacttgctactccctatcgtatgccccactcagttcagaaaactaatcaatgttttaattgcggaaccaagaagtttcctcatccccacgaccaataataattcttctctgatgc

SEQ ID NO: 92 - DNA, 20 bp, Zea mays
gcaccatcgatggttaccgg

SEQ ID NO: 93 - DNA, 22 bp, Zea mays
gaaactgtataagcatgggtgg

SEQ ID NO: 94 - DNA, 201 bp, Zea mays
gaatttgaaatatagtaaaagtaataatataattcatccccaatgaaataaatcaggaggaagacctcttctcgtccattactagcagtaccataaaaagaaaacagtggcaacggccacgatgcagagagagtactgccatgcaatgcaaaccattcgaagccggtagcctaaaacagtcggaacccaacccaaagcagg

SEQ ID NO: 95 - DNA, 22 bp, Zea mays
gaaattgccatgagctcagcgg

SEQ ID NO: 96 - DNA, 22 bp, Zea mays
gttgaatgtggctctcatgagg

SEQ ID NO: 97 - DNA, 25 bp, Zea mays
gcttctctcgccaagttgccatagg

SEQ ID NO: 98 - DNA, 21 bp, Zea mays
gtctaccgacttgctcctcgg

SEQ ID NO: 99 - DNA, 201 bp, Zea mays
ctgcaaaattctaaattaaaaaaatggacaagagaatttgaataaaggtctcataattaacagtgtcacatcacccacagcatggctgctcatgcttcttactgaacaagttccatccatatttcaatcagatttagccatggaacactgacttactgggatagggagaaatataaatatttacacaggggataagctata

SEQ ID NO: 100 - DNA, 21 bp, Zea mays
gtccattcatgtctgaagtgg

SEQ ID NO: 101 - DNA, 20 bp, Zea mays
gcttgctggagtgcttatgg

SEQ ID NO: 102 - DNA, 23 bp, Zea mays
gactagaaacaggtgtcagcagg

SEQ ID NO: 103 - DNA, 22 bp, Zea mays
gattccttcatgcgcttactgg

SEQ ID NO: 104 - DNA, 20 bp, Zea mays
gagcagtgtcgcacatcagg

SEQ ID NO: 105 - DNA, 201 bp, Zea mays
tgaaaccaatctgccatggtgctagtttatatctagccatcatatgcgttaagcaagcatacatactgaaatgatccctgcatctttgtcctatcctatagcatgtgactgctgcctgactacttgtgtctacagtctacacatgtaaaaagagataatgtggagactgtgtttgctagataactttaaagatttcaacta

SEQ ID NO: 106 - DNA, 7844 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgctgtggacgtggggtgctgttttagagctagaaatagcaagttaaaataaggctagtccgttatcaacttgaaaaagtggcaccgagtcggtgcttttttttt

SEQ ID NO: 107 - DNA, 7844 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaccacactgaacaacaagttttagagctagaaatagcaagttaaaataaggctagtccgttatcaacttgaaaaagtggcaccgagtcggtgcttttttttt

SEQ ID NO: 108 - DNA, 7846 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgccgcctaggtagaaatgtgagttttagagctagaaatagcaagttaaaataaggctagtccgttatcaacttgaaaaagtggcaccgagtcggtgcttttttttt

SEQ ID NO: 109 - DNA, 7846 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgactaaatgtaattgctacttgttttagagctagaaatagcaagttaaaataaggctagtccgttatcaacttgaaaaagtggcaccgagtcggtgcttttttttt

SEQ ID NO: 110 - DNA, 7845 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgagggaggcctgtgacgcatgttttagagctagaaatagcaagttaaaataaggctagtccgttatcaacttgaaaaagtggcaccgagtcggtgcttttttttt

SEQ ID NO: 111 - DNA, 7847 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcaggacagggaggtaaaaggagttttagagctagaaatagcaagttaaaataaggctagtccgttatcaacttgaaaaagtggcaccgagtcggtgcttttttttt

SEQ ID NO: 112 - DNA, 7845 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaccgttgctgatggatcaagttttagagctagaaatagcaagttaaaataaggctagtccgttatcaacttgaaaaagtggcaccgagtcggtgcttttttttt

SEQ ID NO: 113 - DNA, 7844 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgttccaacgatgacaagacgttttagagctagaaatagcaagttaaaataaggctagtccgttatcaacttgaaaaagtggcaccgagtcggtgcttttttttt

SEQ ID NO: 114 - DNA, 7845 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcacaataatggtcctccttgttttagagctagaaatagcaagttaaaataaggctagtccgttatcaacttgaaaaagtggcaccgagtcggtgcttttttttt

SEQ ID NO: 115 - DNA, 7844 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgatgatgacaatgaccacagttttagagctagaaatagcaagttaaaataaggctagtccgttatcaacttgaaaaagtggcaccgagtcggtgcttttttttt

SEQ ID NO: 116 - DNA, 7845 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgtgccagaggcagcatcgacgttttagagctagaaatagcaagttaaaataaggctagtccgttatcaacttgaaaaagtggcaccgagtcggtgcttttttttt

SEQ ID NO: 117 - DNA, 7845 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgctcttgggctcaagagagtgttttagagctagaaatagcaagttaaaataaggctagtccgttatcaacttgaaaaagtggcaccgagtcggtgcttttttttt

SEQ ID NO: 118 - DNA, 7846 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgagacatcctcattctagagcgttttagagctagaaatagcaagttaaaataaggctagtccgttatcaacttgaaaaagtggcaccgagtcggtgcttttttttt

SEQ ID NO: 119 - DNA, 7847 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcctcagtcatagttccactctgttttagagctagaaatagcaagttaaaataaggctagtccgttatcaacttgaaaaagtggcaccgagtcggtgcttttttttt

SEQ ID NO: 120 - DNA, 7845 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgagcttgttatcagatgcaggttttagagctagaaatagcaagttaaaataaggctagtccgttatcaacttgaaaaagtggcaccgagtcggtgcttttttttt

SEQ ID NO: 121 - DNA, 7844 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgagctatacctagtgataagttttagagctagaaatagcaagttaaaataaggctagtccgttatcaacttgaaaaagtggcaccgagtcggtgcttttttttt

SEQ ID NO: 122 - DNA, 7849 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaatatccctttctacgaaagaatgttttagagctagaaatagcaagttaaaataaggctagtccgttatcaacttgaaaaagtggcaccgagtcggtgcttttttttt

SEQ ID NO: 123 - DNA, 7847 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgtcaatggagaattctctgttagttttagagctagaaatagcaagttaaaataaggctagtccgttatcaacttgaaaaagtggcaccgagtcggtgcttttttttt

SEQ ID NO: 124 - DNA, 7842 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgtacgtaacgtgcagtacgttttagagctagaaatagcaagttaaaataaggctagtccgttatcaacttgaaaaagtggcaccgagtcggtgctttttttt

SEQ ID NO: 125 - DNA, 7846 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgtgctccctgctactgcgaacgttttagagctagaaatagcaagttaaaataaggctagtccgttatcaacttgaaaaagtggcaccgagtcggtgcttttttttt

SEQ ID NO: 126 - DNA, 7843 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattggtgcaggcaggagaattgttttagagctagaaatagcaagttaaaataaggctagtccgttatcaacttgaaaaagtggcaccgagtcggtgcttttttttt

SEQ ID NO: 127 - DNA, 7847 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgatcgatacacatacacttgcagttttagagctagaaatagcaagttaaaataaggctagtccgttatcaacttgaaaaagtggcaccgagtcggtgcttttttttt

SEQ ID NO: 128 - DNA, 7849 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataataagtgaggagataatctgttttagagctagaaatagcaagttaaaataaggctagtccgttatcaacttgaaaaagtggcaccgagtcggtgcttttttttt

SEQ ID NO: 129 - DNA, 7844 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcaatttgtatcttgcgcagttttagagctagaaatagcaagttaaaataaggctagtccgttatcaacttgaaaaagtggcaccgagtcggtgcttttttttt

SEQ ID NO: 130 - DNA, 7845 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaggaaacacagacaagttggttttagagctagaaatagcaagttaaaataaggctagtccgttatcaacttgaaaaagtggcaccgagtcggtgcttttttttt

SEQ ID NO: 131 - DNA, 7848 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgtacttgctcactgtctaaatacgttttagagctagaaatagcaagttaaaataaggctagtccgttatcaacttgaaaaagtggcaccgagtcggtgcttttttttt

SEQ ID NO: 132 - DNA, 7846 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgcttttttttt

SEQ ID NO: 133 - DNA, 7843 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgctcgtgttggagatacagttttagagctagaaatagcaagttaaaataaggctagtccgttatcaacttgaaaaagtggcaccgagtcggtgcttttttttt

SEQ ID NO: 134 - DNA, 7844 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgtgagcctgagcccatgcagttttagagctagaaatagcaagttaaaataaggctagtccgttatcaacttgaaaaagtggcaccgagtcggtgcttttttttt

SEQ ID NO: 135 - DNA, 7845 bp, Artificial
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgttgatcaaagcgatggcacgttttagagctagaaatagcaagttaaaataaggctagtccgttatcaacttgaaaaagtggcaccgagtcggtgcttttttttt

SEQ ID NO: 136 - DNA, 7845 bp, Artificial sequence
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcagttggatatgtctagccgttttagagctagaaatagcaagttaaaataaggctagtccgttatcaacttgaaaaagtggcaccgagtcggtgcttttttttt

SEQ ID NO: 137 - DNA, 7847 bp, Artificial sequence
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgacacgcactgcaccccgtcgtgttttagagctagaaatagcaagttaaaataaggctagtccgttatcaacttgaaaaagtggcaccgagtcggtgcttttttttt

SEQ ID NO: 138 - DNA, 7844 bp, Artificial sequence
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcacagcttacatcagcttgttttagagctagaaatagcaagttaaaataaggctagtccgttatcaacttgaaaaagtggcaccgagtcggtgcttttttttt

SEQ ID NO: 139 - DNA, 7847 bp, Artificial sequence
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcatgtacatgcaatgcaatcagttttagagctagaaatagcaagttaaaataaggctagtccgttatcaacttgaaaaagtggcaccgagtcggtgcttttttttt

SEQ ID NO: 140 - DNA, 7847 bp, Artificial sequence
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgacctgtacaggaaggcaacgagttttagagctagaaatagcaagttaaaataaggctagtccgttatcaacttgaaaaagtggcaccgagtcggtgcttttttttt

SEQ ID NO: 141 - DNA, 7847 bp, Artificial sequence
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaactcttgcacggccaatccagttttagagctagaaatagcaagttaaaataaggctagtccgttatcaacttgaaaaagtggcaccgagtcggtgcttttttttt

SEQ ID NO: 142 - DNA, 7848 bp, Artificial sequence
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaactcgaggaagacggttctaggttttagagctagaaatagcaagttaaaataaggctagtccgttatcaacttgaaaaagtggcaccgagtcggtgcttttttttt

SEQ ID NO: 143 - DNA, 7844 bp, Artificial sequence
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcagcggaactgtgagtgagttttagagctagaaatagcaagttaaaataaggctagtccgttatcaacttgaaaaagtggcaccgagtcggtgcttttttttt

SEQ ID NO: 144 - DNA, 7845 bp, Artificial sequence
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgtacgtgtgcgctatcaaaggttttagagctagaaatagcaagttaaaataaggctagtccgttatcaacttgaaaaagtggcaccgagtcggtgcttttttttt

SEQ ID NO: 145 - DNA, 7845 bp, Artificial sequence
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgccgtgcgacacacgtactggttttagagctagaaatagcaagttaaaataaggctagtccgttatcaacttgaaaaagtggcaccgagtcggtgcttttttttt

SEQ ID NO: 146 - DNA, 7847 bp, Artificial sequence
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgggctgcaggaattcgatagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaccacggccagctgtagcgctgttttagagctagaaatagcaagttaaaataaggctagtccgttatcaacttgaaaaagtggcaccgagtcggtgcttttttttt

SEQ ID NO: 147 - DNA, 13 bp, Artificial
  synthesized sequence
agcgcccagcacc

SEQ ID NO: 148 - DNA, 18 bp, Artificial
  synthesized sequence
gattggacgtgcggctgt

SEQ ID NO: 149 - DNA, 16 bp, Artificial
  synthesized sequence
tagccatcgcgtgccc

SEQ ID NO: 150 - DNA, 16 bp, Artificial
  synthesized sequence
ctgccgttgttgttca

SEQ ID NO: 151 - DNA, 24 bp, Artificial
  synthesized sequence
tgtgtgaatcccatttctcctaga

SEQ ID NO: 152 - DNA, 16 bp, Artificial
  synthesized sequence
tagccatcgcgtgccc

SEQ ID NO: 153 - DNA, 20 bp, Artificial
  synthesized sequence
taggtagaaatgtgaaggtc

SEQ ID NO: 154 - DNA, 20 bp, Artificial
  synthesized sequence
agaggttgagacgctccacg

SEQ ID NO: 155 - DNA, 22 bp, Artificial
  synthesized sequence
gtgcgtgctttgtttgtttctt

SEQ ID NO: 156 - DNA, 17 bp, Artificial
  synthesized sequence
cccaagtagcaattaca

SEQ ID NO: 157 - DNA, 29 bp, Artificial
  synthesized sequence
ggctaggtaatggttgaatctacatatta

SEQ ID NO: 158 - DNA, 18 bp, Artificial
  synthesized sequence
ttctgcgtttgctcgcct

SEQ ID NO: 159 - DNA, 19 bp, Artificial
  synthesized sequence
acttctccaatgcgtcaca

SEQ ID NO: 160 - DNA, 19 bp, Artificial
  synthesized sequence
agaagcaggctcgccagaa

SEQ ID NO: 161 - DNA, 18 bp, Artificial
  synthesized sequence
gcaacccctccctcgtct

SEQ ID NO: 162 - DNA, 18 bp, Artificial
  synthesized sequence
cctccatccttttacctc

SEQ ID NO: 163 - DNA, 21 bp, Artificial
  synthesized sequence
cagttgctggtatgccttgct

SEQ ID NO: 164 - DNA, 21 bp, Artificial
  synthesized sequence
gcacaggagcaaccagaatca

SEQ ID NO: 165 - DNA, 16 bp, Artificial
  synthesized sequence
ttgctgatggatcaat

SEQ ID NO: 166 - DNA, 19 bp, Artificial
  synthesized sequence
ggagaagaggtgccttggc

SEQ ID NO: 167 - DNA, 24 bp, Artificial
  synthesized sequence
tatgttagccctaatctcgaccgt

SEQ ID NO: 168 - DNA, 20 bp, Artificial
  synthesized sequence
tagtccagtcttgtcatcgt

SEQ ID NO: 169 - DNA, 25 bp, Artificial
  synthesized sequence
cttaccatctttcatccttcgtctt

SEQ ID NO: 170 - DNA, 21 bp, Artificial
  synthesized sequence
tccagtgcatatcgcagttcc

SEQ ID NO: 171 - DNA, 20 bp, Artificial
  synthesized sequence
caaatcctaaggaggaccat

SEQ ID NO: 172 - DNA, 24 bp, Artificial
  synthesized sequence
tccgacataaatctgtggtcacat

SEQ ID NO: 173 - DNA, 25 bp, Artificial
  synthesized sequence
cgcttctaccatatgtagttgttgc

SEQ ID NO: 174 - DNA, 19 bp, Artificial
  synthesized sequence
tactccatgtggtcattgt

SEQ ID NO: 175 - DNA, 20 bp, Artificial
  synthesized sequence
tctgtcgctcgtccaaatcc

SEQ ID NO: 176 - DNA, 18 bp, Artificial
  synthesized sequence
caggtggggaagcacgac

SEQ ID NO: 177 - DNA, 15 bp, Artificial
  synthesized sequence
ttgccggtcgatgct

SEQ ID NO: 178 - DNA, 23 bp, Artificial
  synthesized sequence
cgcttttttctcctgctattctg

SEQ ID NO: 179 - DNA, 20 bp, Artificial
  synthesized sequence
aagacaggcagtgccagagg

SEQ ID NO: 180 - DNA, 21 bp, Artificial
  synthesized sequence
cctaaacctactctcttgagc

SEQ ID NO: 181 - DNA, 24 bp, Artificial
  synthesized sequence
tgacactttgtattggtgctcttg

SEQ ID NO: 182 - DNA, 23 bp, Artificial
  synthesized sequence
caaaggaaaggggagtaaccaac

SEQ ID NO: 183 - DNA, 18 bp, Artificial
  synthesized sequence
tctgaatacccgctctag

SEQ ID NO: 184 - DNA, 27 bp, Artificial
  synthesized sequence
ttcatctatcctaatgagacatcctca

SEQ ID NO: 185 - DNA, 24 bp, Artificial
  synthesized sequence
agggtcataatgcaagactcgaat

SEQ ID NO: 186 - DNA, 19 bp, Artificial
  synthesized sequence
tagttccactctcggcaac

SEQ ID NO: 187 - DNA, 22 bp, Artificial
  synthesized sequence
tggtgagagaagaggcttttgg

SEQ ID NO: 188 - DNA, 24 bp, Artificial
  synthesized sequence
acacctagcctagatgcctcagtc

SEQ ID NO: 189 - DNA, 16 bp, Artificial
  synthesized sequence
ccaagcctctgcatct

SEQ ID NO: 190 - DNA, 17 bp, Artificial
  synthesized sequence
cgaaccttgtccgcgtc

SEQ ID NO: 191 - DNA, 24 bp, Artificial
  synthesized sequence
caaagtcccagagagcttgttatc

SEQ ID NO: 192 - DNA, 21 bp, Artificial
  synthesized sequence
tgctcctttatcactaggtat

SEQ ID NO: 193 - DNA, 29 bp, Artificial
  synthesized sequence
gaataaactagacgaaaaatgaggttgac

SEQ ID NO: 194 - DNA, 25 bp, Artificial
  synthesized sequence
aggactgatgagacttgtcttgagc

SEQ ID NO: 195 - DNA, 15 bp, Artificial
  synthesized sequence
tttgccaattctttc

SEQ ID NO: 196 - DNA, 26 bp, Artificial
  synthesized sequence
gcaaaagctcttagaatatccctttc

SEQ ID NO: 197 - DNA, 28 bp, Artificial
  synthesized sequence
agctataataaagtcttcccctctagtt

SEQ ID NO: 198 - DNA, 21 bp, Artificial
  synthesized sequence
attctctgttaaggaatgact

SEQ ID NO: 199 - DNA, 19 bp, Artificial
  synthesized sequence
cggagcatttttctcccca

SEQ ID NO: 200 - DNA, 23 bp, Artificial
  synthesized sequence
tgactacggatgtcaatggagaa

SEQ ID NO: 201 - DNA, 16 bp, Artificial
  synthesized sequence
cctgctactgcgaacc

SEQ ID NO: 202 - DNA, 17 bp, Artificial
  synthesized sequence
ccaaccagcggcagagg

SEQ ID NO: 203 - DNA, 19 bp, Artificial
  synthesized sequence
gcagcgtacatggctcatg

SEQ ID NO: 204 - DNA, 20 bp, Artificial
  synthesized sequence
tgttccaaattctcctgcct

SEQ ID NO: 205 - DNA, 26 bp, Artificial
  synthesized sequence
gttcttatatctggcgataaccactt

SEQ ID NO: 206 - DNA, 26 bp, Artificial
  synthesized sequence
ttgtagcacttgcacgtagttacata

SEQ ID NO: 207 - DNA, 19 bp, Artificial
  synthesized sequence
cacatacacttgcacggca

SEQ ID NO: 208 - DNA, 25 bp, Artificial
  synthesized sequence
tgggagtagtagtgaacggaatacg

SEQ ID NO: 209 - DNA, 24 bp, Artificial
  sunthesized sequence
tccaaaaattatatagcacgcacg

SEQ ID NO: 210 - DNA, 18 bp, Artificial
  synthesized sequence
cgtccaagattatctcct

SEQ ID NO: 211 - DNA, 24 bp, Artificial
  synthesized sequence
ccaccactctcgcataataagtga

SEQ ID NO: 212 - DNA, 25 bp, Artificial
  synthesized sequence
gcttggaatcagtagaatggaacac

SEQ ID NO: 213 - DNA, 21 bp, Artificial
  synthesized sequence
taggcaatttgtatcttgcgc

SEQ ID NO: 214 - DNA, 21 bp, Artificial
  synthesized sequence
acacctccagtagccacatcc

SEQ ID NO: 215 - DNA, 27 bp, Artificial
  synthesized sequence
tgctttacgctaggtgtgtatcttaca

SEQ ID NO: 216 - DNA, 17 bp, Artificial
  synthesized sequence
aaacacagacaagttgg

SEQ ID NO: 217 - DNA, 24 bp, Artificial
  synthesized sequence
gaatcacattctctcctccctctt

SEQ ID NO: 218 - DNA, 16 bp, Artificial
  synthesized sequence
cgcagaatcggcgagg

SEQ ID NO: 219 - DNA, 22 bp, Artificial
  synthesized sequence
actgtctaaatactggtatctt

SEQ ID NO: 220 - DNA, 29 bp, Artificial
  synthesized sequence
gatggaggatagaattgtatcttttagga

SEQ ID NO: 221 - DNA, 29 bp, Artificial
  synthesized sequence
actgtcttaatttactcgactctttctta

SEQ ID NO: 222 - DNA, 18 bp, Artificial
  synthesized sequence
attgctcctcatcctcga

SEQ ID NO: 223 - DNA, 24 bp, Artificial
  synthesized sequence
ccacggactggattagatagtggt

SEQ ID NO: 224 - DNA, 25 bp, Artificial
  synthesized sequence
tctagctttgcatcatgtcttgaac

SEQ ID NO: 225 - DNA, 18 bp, Artificial
  synthesized sequence
tgtccctgtatctccaac

SEQ ID NO: 226 - DNA, 19 bp, Artificial
  synthesized sequence
ggcaggaatcaaggctcgt

SEQ ID NO: 227 - DNA, 20 bp, Artificial
  synthesized sequence
gcctcgccttcgctagttaa

SEQ ID NO: 228 - DNA, 16 bp, Artificial
  synthesized sequence
agcctgagcccatgca

SEQ ID NO: 229 - DNA, 17 bp, Artificial
  synthesized sequence
agccaccgcactccacc

SEQ ID NO: 230 - DNA, 18 bp, Artificial
  synthesized sequence
gcttctgcgatctgcggt

SEQ ID NO: 231 - DNA, 14 bp, Artificial
  synthesized sequence
cctgtgccatcgct

SEQ ID NO: 232 - DNA, 19 bp, Artificial
  synthesized sequence
catgtggcgaaggttggat

SEQ ID NO: 233 - DNA, 26 bp, Artificial
  synthesized sequence
ggaagaaaaaagatgttatcgaaagc

SEQ ID NO: 234 - DNA, 19 bp, Artificial
  synthesized sequence
agttggatatgtctagccg

SEQ ID NO: 235 - DNA, 24 bp, Artificial
  synthesized sequence
tgagggagaaattaaacatccagc

SEQ ID NO: 236 - DNA, 18 bp, Artificial
  synthesized sequence
ttggcgtgaaacggagct

SEQ ID NO: 237 - DNA, 14 bp, Artificial
  synthesized sequence
tgcaccccgtcgtc

SEQ ID NO: 238 - DNA, 22 bp, Artificial
  synthesized sequence
agagaaagcagatgacacgcac

SEQ ID NO: 239 - DNA, 24 bp, Artificial
  synthesized sequence
caaatccgattaccacacattagc

SEQ ID NO: 240 - DNA, 19 bp, Artificial
  synthesized sequence
agcttacatcagctttggt

SEQ ID NO: 241 - DNA, 26 bp, Artificial
  synthesized sequence
tcgagataaccctagaaaaaatggtt

SEQ ID NO: 242 - DNA, 19 bp, Artificial
  synthesized sequence
gtggtccaccatcgagcaa

SEQ ID NO: 243 - DNA, 16 bp, Artificial
  synthesized sequence
accgtgattgcattgc

SEQ ID NO: 244 - DNA, 21 bp, Artificial
  synthesized sequence
tggaaacgcttcatattcgga

SEQ ID NO: 245 - DNA, 23 bp, Artificial
  synthesized sequence
tctctccgatgccattgaactag

SEQ ID NO: 246 - DNA, 15 bp, Artificial
  synthesized sequence
aggaaggcaacgatg

SEQ ID NO: 247 - DNA, 21 bp, Artificial
  synthesized sequence
atgttcgccacctttatttgc

SEQ ID NO: 248 - DNA, 20 bp, Artificial
  synthesized sequence
catcaacccgttctgtccct

SEQ ID NO: 249 - DNA, 15 bp, Artificial
  synthesized sequence
tctcggccatggatt

SEQ ID NO: 250 - DNA, 19 bp, Artificial
  synthesized sequence
tggtcgaactcttgcacgg

SEQ ID NO: 251 - DNA, 24 bp, Artificial
  synthesized sequence
attttttgaacaagaaccgtggac

SEQ ID NO: 252 - DNA, 14 bp, Artificial
  synthesized sequence
ctggccgctagaac

SEQ ID NO: 253 - DNA, 23 bp, Artificial
  synthesized sequence
cggaaaaggaacagtcttgattg

SEQ ID NO: 254 - DNA, 23 bp, Artificial
  synthesized sequence
tgtgctctctacctttgcatgtg

SEQ ID NO: 255 - DNA, 17 bp, Artificial
  synthesized sequence
cggaactgtgagtgacg

SEQ ID NO: 256 - DNA, 25 bp, Artificial
  synthesized sequence
ctagcctagcaggagtacgagttgt

SEQ ID NO: 257 - DNA, 26 bp, Artificial
  synthesized sequence
tgtcctagtttttcatctgcaatctg

SEQ ID NO: 258 - DNA, 18 bp, Artificial
  synthesized sequence
atggtccactttgatagc

SEQ ID NO: 259 - DNA, 20 bp, Artificial
  synthesized sequence
ggtcgtagtgccgttgatgg

SEQ ID NO: 260 - DNA, 21 bp, Artificial
  synthesized sequence
ccagtccctgtgtacgtgtgc

SEQ ID NO: 261 - DNA, 18 bp, Artificial
  synthesized sequence
acacacgtactgcggcgt

SEQ ID NO: 262 - DNA, 22 bp, Artificial
  synthesized sequence
tgtctttcttgtcgctgtggat

SEQ ID NO: 263 - DNA, 19 bp, Artificial
  synthesized sequence
ccacacgtcgtccgagttc

SEQ ID NO: 264 - DNA, 19 bp, Artificial
  synthesized sequence
aactcgtaaacctagcgct

SEQ ID NO: 265 - DNA, 23 bp, Artificial
  synthesized sequence
tagccgaaacatgacctctttga

SEQ ID NO: 266 - DNA, 21 bp, Artificial
  synthesized sequence
accccaataaaaccccctagc

SEQ ID NO: 267 - RNA, 96 nt, artificial
  synthesized sequence
gcuguggacguggggugcuguuuuagagcuagaaauagcaaguuaaaauaaggcuaguccguuaucaacuugaaaaaguggcaccgagucggugcu

SEQ ID NO: 268 - RNA, 96 nt, artificial
  synthesized sequence
gaaccacacugaacaacaaguuuuagagcuagaaauagcaaguuaaaauaaggcuaguccguuaucaacuugaaaaaguggcaccgagucggugcu

SEQ ID NO: 269 - RNA, 98 nt, artificial
  synthesized sequence
gccgccuagguagaaaugugaguuuuagagcuagaaauagcaaguuaaaauaaggcuaguccguuaucaacuugaaaaaguggcaccgagucggugcu

SEQ ID NO: 270 - RNA, 98 nt, artificial
  synthesized sequence
gacuaaauguaauugcuacuuguuuuagagcuagaaauagcaaguuaaaauaaggcuaguccguuaucaacuugaaaaaguggcaccgagucggugcu

SEQ ID NO: 271 - RNA, 97 nt, artificial
  synthesized sequence
gagggaggccugugacgcauguuuuagagcuagaaauagcaaguuaaaauaaggcuaguccguuaucaacuugaaaaaguggcaccgagucggugcu

SEQ ID NO: 272 - RNA, 99 nt, artificial
  synthesized sequence
gcaggacagggagguaaaaggaguuuuagagcuagaaauagcaaguuaaaauaaggcuaguccguuaucaacuugaaaaaguggcaccgagucggugcu

SEQ ID NO: 273 - RNA, 97 nt, artificial
  synthesized sequence
gaccguugcugauggaucaaguuuuagagcuagaaauagcaaguuaaaauaaggcuaguccguuaucaacuugaaaaaguggcaccgagucggugcu

SEQ ID NO: 274 - RNA, 96 nt, artificial
  synthesized sequence
guuccaacgaugacaagacguuuuagagcuagaaauagcaaguuaaaauaaggcuaguccguuaucaacuugaaaaaguggcaccgagucggugcu

SEQ ID NO: 275 - RNA, 97 nt, artificial
  synthesized sequence
gcacaauaaugguccuccuuguuuuagagcuagaaauagcaaguuaaaauaaggcuaguccguuaucaacuugaaaaaguggcaccgagucggugcu

SEQ ID NO: 276 - RNA, 96 nt, artificial
  synthesized sequence
gaugaugacaaugaccacaguuuuagagcuagaaauagcaaguuaaaauaaggcuaguccguuaucaacuugaaaaaguggcaccgagucggugcu

SEQ ID NO: 277 - RNA, 97 nt, artificial
  synthesized sequence
gugccagaggcagcaucgacguuuuagagcuagaaauagcaaguuaaaauaaggcuaguccguuaucaacuugaaaaaguggcaccgagucggugcu

SEQ ID NO: 278 - RNA, 97 nt, artificial
  synthesized sequence
gcucuugggcucaagagaguguuuuagagcuagaaauagcaaguuaaaauaaggcuaguccguuaucaacuugaaaaaguggcaccgagucggugcu

SEQ ID NO: 279 - RNA, 98 nt, artificial
  synthesized sequence
gagacauccucauucuagagcguuuuagagcuagaaauagcaaguuaaaauaaggcuaguccguuaucaacuugaaaaaguggcaccgagucggugcu

SEQ ID NO: 280 - RNA, 99 nt, artificial
  synthesized sequence
gccucagucauaguuccacucuguuuuagagcuagaaauagcaaguuaaaauaaggcuaguccguuaucaacuugaaaaaguggcaccgagucggugcu

SEQ ID NO: 281 - RNA, 97 nt, artificial
  synthesized sequence
gagcuuguuaucagaugcagguuuuagagcuagaaauagcaaguuaaaauaaggcuaguccguuaucaacuugaaaaaguggcaccgagucggugcu

SEQ ID NO: 282 - RNA, 96 nt, artificial
  synthesized sequence
gagcuauaccuagugauaaguuuuagagcuagaaauagcaaguuaaaauaaggcuaguccguuaucaacuugaaaaaguggcaccgagucggugcu

SEQ ID NO: 283 - RNA, 101 nt, artificial
  synthesized sequence
gaauaucccuuucuacgaaagaauguuuuagagcuagaaauagcaaguuaaaauaaggcuaguccguuaucaacuugaaaaaguggcaccgagucggugcu

SEQ ID NO: 284 - RNA, 98 nt, artificial
  synthesized sequence
gucaauggagaauucucuguuguuuuagagcuagaaauagcaaguuaaaauaaggcuaguccguuaucaacuugaaaaaguggcaccgagucggugcu

SEQ ID NO: 285 - RNA, 95 nt, artificial
  synthesized sequence
guacguaacgugcaguacguuuuagagcuagaaauagcaaguuaaaauaaggcuaguccguuaucaacuugaaaaaguggcaccgagucggugcu

SEQ ID NO: 286 - RNA, 98 nt, artificial
  synthesized sequence
gugcucccugcuacugcgaacguuuuagagcuagaaauagcaaguuaaaauaaggcuaguccguuaucaacuugaaaaaguggcaccgagucggugcu

SEQ ID NO: 287 - RNA, 95 nt, artificial
  synthesized sequence
ggugcaggcaggagaauuguuuuagagcuagaaauagcaaguuaaaauaaggcuaguccguuaucaacuugaaaaaguggcaccgagucggugcu

SEQ ID NO: 288 - RNA, 99 nt, artificial
  synthesized sequence
gaucgauacacauacacuugcaguuuuagagcuagaaauagcaaguuaaaauaaggcuaguccguuaucaacuugaaaaaguggcaccgagucggugcu

SEQ ID NO: 289 - RNA, 101 nt, artificial
  synthesized sequence
gcauaauaagugaggagauaaucuguuuuagagcuagaaauagcaaguuaaaauaaggcuaguccguuaucaacuugaaaaaguggcaccgagucggugcu

SEQ ID NO: 290 - RNA, 96 nt, artificial
  synthesized sequence
gcaauuuguaucuugcgcaguuuuagagcuagaaauagcaaguuaaaauaaggcuaguccguuaucaacuugaaaaaguggcaccgagucggugcu

SEQ ID NO: 291 - RNA, 97 nt, artificial
  synthesized sequence
gaggaaacacagacaaguugguuuuagagcuagaaauagcaaguuaaaauaaggcuaguccguuaucaacuugaaaaaguggcaccgagucggugcu

SEQ ID NO: 292 - RNA, 100 nt, artificial
  synthesized sequence
guacuugcucacugucuaaauacguuuuagagcuagaaauagcaaguuaaaauaaggcuaguccguuaucaacuugaaaaaguggcaccgagucggugcu

SEQ ID NO: 293 - RNA, 98 nt, artificial
  synthesized sequence
gcauaaugaggaucgaggaugguuuuagagcuagaaauagcaaguuaaaauaaggcuaguccguuaucaacuugaaaaaguggcaccgagucggugcu

SEQ ID NO: 294 - RNA, 95 nt, artificial
  synthesized sequence
gcucguguuggagauacaguuuuagagcuagaaauagcaaguuaaaauaaggcuaguccguuaucaacuugaaaaaguggcaccgagucggugcu

SEQ ID NO: 295 - RNA, 96 nt, artificial
  synthesized sequence
gugagccugagcccaugcaguuuuagagcuagaaauagcaaguuaaaauaaggcuaguccguuaucaacuugaaaaaguggcaccgagucggugcu

SEQ ID NO: 296 - RNA, 97 nt, artificial
  synthesized sequence
guugaucaaagcgauggcacguuuuagagcuagaaauagcaaguuaaaauaaggcuaguccguuaucaacuugaaaaaguggcaccgagucggugcu

SEQ ID NO: 297 - RNA, 97 nt, Artificial
  synthesized sequence
gcaguuggauaugucuagccguuuuagagcuagaaauagcaaguuaaaauaaggcuaguccguuaucaacuugaaaaaguggcaccgagucggugcu

SEQ ID NO: 298 - RNA, 99 nt, Artificial
  synthesized sequence
gacacgcacugcaccccgucguguuuuagagcuagaaauagcaaguuaaaauaaggcuaguccguuaucaacuugaaaaaguggcaccgagucggugcu

SEQ ID NO: 299 - RNA, 96 nt, Artificial
  synthesized sequence
gcacagcuuacaucagcuuguuuuagagcuagaaauagcaaguuaaaauaaggcuaguccguuaucaacuugaaaaaguggcaccgagucggugcu

SEQ ID NO: 300 - RNA, 99 nt, Artificial
  synthesized sequence
gcauguacaugcaaugcaaucaguuuuagagcuagaaauagcaaguuaaaauaaggcuaguccguuaucaacuugaaaaaguggcaccgagucggugcu

SEQ ID NO: 301 - RNA, 99 nt, Artificial
  synthesized sequence
gaccuguacaggaaggcaacgaguuuuagagcuagaaauagcaaguuaaaauaaggcuaguccguuaucaacuugaaaaaguggcaccgagucggugcu

SEQ ID NO: 302 - RNA, 99 nt, Artificial
  synthesized sequence
gaacucuugcacggccaauccaguuuuagagcuagaaauagcaaguuaaaauaaggcuaguccguuaucaacuugaaaaaguggcaccgagucggugcu

SEQ ID NO: 303 - RNA, 100 nt, Artificial
  synthesized sequence
gaacucgaggaagacgguucuagguuuuagagcuagaaauagcaaguuaaaauaaggcuaguccguuaucaacuugaaaaaguggcaccgagucggugcu

SEQ ID NO: 304 - RNA, 96 nt, Artificial
  synthesized sequence
gcagcggaacugugagugaguuuuagagcuagaaauagcaaguuaaaauaaggcuaguccguuaucaacuugaaaaaguggcaccgagucggugcu

SEQ ID NO: 305 - RNA, 97 nt, Artificial
  synthesized sequence
guacgugugcgcuaucaaagguuuuagagcuagaaauagcaaguuaaaauaaggcuaguccguuaucaacuugaaaaaguggcaccgagucggugcu

SEQ ID NO: 306 - RNA, 97 nt, Artificial
  synthesized sequence
gccgugcgacacacguacugguuuuagagcuagaaauagcaaguuaaaauaaggcuaguccguuaucaacuugaaaaaguggcaccgagucggugcu

SEQ ID NO: 307 - RNA, 99 nt, Artificial
  synthesized sequence
gaccacggccagcuguagcgcuguuuuagagcuagaaauagcaaguuaaaauaaggcuaguccguuaucaacuugaaaaaguggcaccgagucggugcu

SEQ ID NO: 308 - DNA, 4107 bp, Streptococcus pyogenes M1 GAS (SF370)
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 309 - protein, 9 aa, Simian virus 40
MAPKKKRKV

SEQ ID NO: 310 - protein, 18 aa, Agrobacterium tumefaciens
KRPRDRHDGELGGRKRAR

SEQ ID NO: 311 - DNA, 6717 bp, Artificial Sequence
  synthesized sequence
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggcc

SEQ ID NO: 312 - DNA, 1000 bp, Zea mays
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaatt

SEQ ID NO: 313 - DNA, 4104 bp, Artificial sequence
  synthesized sequence
atggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgac

SEQ ID NO: 314 - protein, 11 aa, Simian virus 40
SRADPKKKRKV

SEQ ID NO: 315 - DNA, 434 bp, Glycine max
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaa

SEQ ID NO: 316 - DNA, 121 bp, Glycine max
aaaattgctttgcgatttttccatttgtgtggatacaggatatatgaatgaataaaacatytattattaaaaaattaatttattaataaattaaaaaacatacggatgaactaatcgtatg

SEQ ID NO: 317 - DNA, 22 bp, Glycine max
acgagcacacatgtcgatttgg

SEQ ID NO: 318 - DNA, 22 bp, Glycine max
gtgctcgttctcgtgagaatgg

SEQ ID NO: 319 - DNA, 23 bp, Glycine max
gccacttcatttactcaacttgg

SEQ ID NO: 320 - DNA, 22 bp, SEQ ID NOs: 106-307, 311,
actcaaagtcatatttttcagg

SEQ ID NO: 321 - DNA, 121 bp, Glycine max
aacttcatacttgacaccatacaaatgatgactccacaactgggagcttaagatcatggaytggataatgtttctcatgtaatattagttgtctattagcacaataacaaatattttttca

SEQ ID NO: 322 - DNA, 121 bp, Glycine max
attattagtgctttgtttttacaaaatatgtcttataacatgtagggaaaagcaaagaagrttgtccaggcacagaacctctggtttgaaattctgaagtcacagatagaaactggaaccc

SEQ ID NO: 323 - DNA, 23 bp, Glycine max
gtcccttgtacttgtacgtacgg

SEQ ID NO: 324 - DNA, 23 bp, Glycine Max
gtattctagaaaagaggaattgg

SEQ ID NO: 325 - DNA, 121 bp, Glycine max
ttctgtaagaggcacttggcatttccaccggcgtttgtagaccctcaccagtcaccaccamctttgtttgcctctgtcgtgcatcatgactggcccctcactcattgtcaattttatatat

SEQ ID NO: 326 - DNA, 121 bp, Glycine max
tcttgacgctaccaatggttttcacaacgacagtctcattggctctggcgggtttggggaygtgtacaaggctcagttgaaggatggaagtgttgtggctatcaagaagctgattcatgtt

SEQ ID NO: 327 - DNA, 22 bp, Glycine Max
gtgctaagcacgacatccatgg

SEQ ID NO: 328 - DNA, 22 bp, Glycine Max
acgtgatgcatcatagatgcgg

SEQ ID NO: 329 - DNA, 121 bp, Glycine max
agagagtccggtggtgagaaaggggagcgtaaacctgcgccaccagacatagttggccggygcactcggcgcagcgaagcaaatcggtgtttatgggaaggggccagtcctgtcatcaaat

SEQ ID NO: 330 - DNA, 121 bp, Glycine max
cgcatgcggtcatccaactcgacaacctctacacctctgacaatgatacgtaactcgacarttgtttcgttaagtaagataatgttactttcatcgggtcgaggacatgacgatgatgtca

SEQ ID NO: 331 - DNA, 22 bp, Glycine Max
aggaaatgactgtggcacatgg

SEQ ID NO: 332 - DNA, 22 bp, Glycine Max
acatggcactgtaacatcacgg

SEQ ID NO: 333 - DNA, 121 bp, Glycine max
agaacctgccagacggagcaacccgagtggtggagccagtcgatgaaacggaacgcctcgycgccgagatcgccgatgccgtaggggccgcgaaacgacgtcgggtggagcagaatgccgc

SEQ ID NO: 334 - DNA, 23 bp, Glycine Max
ggaactgacacacgacatgatgg

SEQ ID NO: 335 - DNA, 23 bp, Glycine Max
gacatgatggaacgtgactaagg

SEQ ID NO: 336 - DNA, 22 bp, Glycine Max
tgtgtgaggtacacaattatgg

SEQ ID NO: 337 - DNA, 23 bp, Glycine Max
gtaatgtacgttgttgtgtgagg

SEQ ID NO: 338 - DNA, 121 bp, Glycine max
ggtctaattattacatcttaggagagagtaacataggtgccaaagccaaagtggctatccmgtgtctgtacagtacaaagactattaattgtatttaacccatctaaaagattggctcttg

SEQ ID NO: 339 - DNA, 121 bp, Glycine max
ccaatatatttcagtttctattggagcattgaagatatctatggttgcttcaacatgatgktgtttaccgtatgaatgacttcttgtgttgaccttgtgtgcaggctcagaagctatgttt

SEQ ID NO: 340 - DNA, 121 bp, Glycine max
ctcacatacgcagaaatcatgctaaacacgattttccttttgaattttttatgaagaaatygtgcacatgctgatgatttagtattttgattttattttatgtaaatctaattagattttg

SEQ ID NO: 341 - DNA, 121 bp, Glycine max
ccatagaatgtctacctcagctttttgggtctgcggctggtcaactcagggtttgaaaackttgcatattataagtatgttaataatgttacacattttaagataaatataaaaggacagt

SEQ ID NO: 342 - DNA, 23 bp, Glycine Max
ggaaacttttgtgagcaagtagg

SEQ ID NO: 343 - DNA, 22 bp, Glycine Max
gaccaaagacttcattaattgg

SEQ ID NO: 344 - DNA, 121 bp, Glycine max
aatttttttgtaggactaatttgttgcactttttgaatattcaaggactggatttgaattytttatctttcaaagaccaatttgtcattgtttcatgtttttatggatgaatttaactatt

SEQ ID NO: 345 - DNA, 121 bp, Glycine max
ttgctagctaagcgaatatggctcgcttagccaatctgtctcgctaagcgattccttcagyagcatttcacacattctcttctttagcctacaaactgagttaaattcaatattaattcac

SEQ ID NO: 346 - DNA, 22 bp, Glycine Max
gcaacgacaatgaagtgcatgg

SEQ ID NO: 347 - DNA, 22 bp, Glycine Max
ccatgcactcacataatcgtgg

SEQ ID NO: 348 - DNA, 121 bp, Glycine max
tttaataaagagggcttgtagtttttacttttgttttccaaacagaaaatggaagatctaygttctgcaattgtctgtactactagactactagtacatgcgttgtcaatgacaggtaaca

SEQ ID NO: 349 - DNA, 121 bp, Glycine max
attagcagtagtaacaaaccaagttctgcatttcttattggatagtttttactaaataatytttattgtaacttttaaactgtacttacaggatgaagagatatagtttagttagttgaag

SEQ ID NO: 350 - DNA, 22 bp, Glycine Max
acacaatttagttgcctgacgg

SEQ ID NO: 351 - DNA, 23 bp, Glycine Max
gaaataaaaggcctataaaaggg

SEQ ID NO: 352 - DNA, 121 bp, Glycine max
ttctgcactcacttttccccttttgggaatggtcaatcaaaaatgtaattttacattatgkaatgcattccttttttgacttccgaaatgaccaatccaaaaggtcaaaataatcgaaaag

SEQ ID NO: 353 - DNA, 121 bp, Glycine max
gagaaatgttactttacggagtaacatgcattctcaaattctgtaggaagaatcctcacgmtgaagtggtctccccttctacgatggtgtagaatggcataggcaattgggaagatatgat

SEQ ID NO: 354 - DNA, 23 bp, Glycine Max
gttcaggttgttgtacgacatgg

SEQ ID NO: 355 - DNA, 22 bp, Glycine Max
atgaagacatgaatcattgagg

SEQ ID NO: 356 - DNA, 121 bp, Glycine max
taccacgataagacaatttttgagtcaattcttcactggaataaacccaataagatttaarattccttcgagatgtagcattgagcaagttgcgtctgtagagactttccttatggaattc

SEQ ID NO: 357 - DNA, 121 bp, Glycine max
ctacatgcttaaagagagagagataccggcatttacctaattgcaaggagatgaatgaggkttcgatcttataatctgttagatgttaaaccttgttcccttcaacttttgggttggagtg

SEQ ID NO: 358 - DNA, 22 bp, Glycine Max
gcaagttgggttatgaaattgg

SEQ ID NO: 359 - DNA, 22 bp, Glycine Max
attatgtatgatgcaagttggg

SEQ ID NO: 360 - DNA, 121 bp, Glycine max
tattttattgtggagtgtgtgaattaatatttttttaatacttattttaattaattgatartataaaactttttactctaacattacaaatgtattttgtttttcaatttttttattaata

SEQ ID NO: 361 - DNA, 121 bp, Glycine max
ttcgaaggtgcataactgcatggataagctcacactaacccgttaatttgtgatccaattyggttccttaggaggtatcgggaaggaattttagaatgtaataatatcgattcatacagat

SEQ ID NO: 362 - DNA, 121 bp, Glycine max
ggcaagagccaactgctggttgtttgcatcagatgcgttgtcagtttttttaggatctgtkgtgggtgacgacctctcctcattggactgtgaatggctggaggaagatgattctttctga

SEQ ID NO: 363 - DNA, 121 bp, Glycine max
tgaaagcaaccaaatatcttgttctttctttcatggctagagatatacttgcccttccagygtttactgtgtcatttgagtccgtattcaacacaggaggtcaattacttgatccatttcg

SEQ ID NO: 364 - DNA, 121 bp, Glycine max
tttaggtgtcctattagtgaagaaggtgtcaggtaaaggcttggtttcttgttagcaaaaraggtgtcactctgatggtctccacccttgcttcttgtttacaaaggaggtgcctccctag

SEQ ID NO: 365 - DNA, 22 bp, Glycine Max
accaaaggcacgtacgtaaagg

SEQ ID NO: 366 - DNA, 22 bp, Glycine Max
gcctttacgtacgtgcctttgg

SEQ ID NO: 367 - DNA, 121 bp, Glycine max
agtgggttaaataaatcaccccattctatagttggtttggttcgacccgacccgtttcgamaaaaaaaaaagtagggacctgaatattcagtgacccatttcgccccgcactgcgtactct

SEQ ID NO: 368 - DNA, 121 bp, Glycine max
ataaatagcattatcctttcaatattttttgcttctaaattcttaattagttattcaaatrttaatacaataccccaactttttttggactgattattagtcttgtaaaactttgtcacta

SEQ ID NO: 369 - DNA, 121 bp, Glycine max
accatcatgaccaccatctctccaccgcaagcaaccacaccctgctcgatacctttgcctytctcattcatggagctttagagactccaagatcagagcctctcctcgcgaaaaggaaaaa

SEQ ID NO: 370 - DNA, 23 bp, Glycine Max
gatagtcatcctagttagtgtgg

SEQ ID NO: 371 - DNA, 23 bp, Glycine Max
gatgtagtaccacactaactagg

SEQ ID NO: 372 - DNA, 121 bp, Glycine max
cagcacatttaactcagatggattaaattttcccattcaccttgaagcaactccttgaggycgactttttctgtttcttttttattaatatgatttctcaaagtacaacactaaaccaaac

SEQ ID NO: 373 - DNA, 121 bp, Glycine max
tgacaatggcgagtttgctgtgcgaaagccacgtggcctggaaaccgtcagtggtgatggmgatttggtagcaggtgcaagttgccagttcctctagcgagtctggtcacaggtaagtaaa

SEQ ID NO: 374 - DNA, 121 bp, Glycine max
tatagaagaggatttgagaaaataaaagagttcttggttggcttggaaacagatctttgcygagtacgatctcttgccctcgagactagagttggaactcgtcgtcatcatagggtaatga

SEQ ID NO: 375 - DNA, 121 bp, Glycine max
aattggctgccccaatcgttcttgatcttgatgagcacactgaggctcacacaaattccaycacgtcgccgccgttacttgtgcttccaccaccaagtcgttgtcgccccgagaagaggat

SEQ ID NO: 376 - DNA, 22 bp, Glycine Max
ctgtaacttctgcactcaccgg

SEQ ID NO: 377 - DNA, 22 bp, Glycine Max
ttattggagagtactttgccgg

SEQ ID NO: 378 - DNA, 121 bp, Glycine max
tagttagcatttgtccttcagcatgtgcatgtcctagttttatacctctaattattataakttggtttttggtttatcaattactagaaactatggttcatgtgcccatttcataaggctc

SEQ ID NO: 379 - DNA, 121 bp, Glycine max
ggacctcgtcatttgcatgatccacatactaaacatccttagcaacaagtacaacttctcrttgcctacatgtaggtgctgtgggctttcgctgctggggtccttcatcgacatcacgact

SEQ ID NO: 380 - DNA, 23 bp, Glycine Max
gtgagatgtggtgcgtacgtagg

SEQ ID NO: 381 - DNA, 22 bp, Glycine Max
gattcttaaaaaagatcgaagg

SEQ ID NO: 382 - DNA, 121 bp, Glycine max
tgatgacatacagttggtacacttggggatggtttcaactaatgttataaaaaccggatcrgattggtttgatcgggagttaagacctacaccggtccgagctagtagttggatcaatcat

SEQ ID NO: 383 - DNA, 121 bp, Glycine max
cagcaccgcccgatgcagtcgcgtatcttcgttaaccacctcccccgcgatcccttcctcrctccttggtagctcttgctcacggacgattgcgcgaaaatccctttctaaacaatagaac

SEQ ID NO: 384 - DNA, 23 bp, Glycine Max
gtgctatggtgctcgtgtaaggg

SEQ ID NO: 385 - DNA, 23 bp, Glycine Max
gatccaagatattgagtgatcgg

SEQ ID NO: 386 - DNA, 121 bp, Glycine max
ttgccacccaccaaccctctctacgcaccctccacttcacccccacccgctcccttctccrcacatcgctcccctctctactccccccctccccgtgcggccatctcttatgcgccgacaa

SEQ ID NO: 387 - DNA, 121 bp, Glycine max
cgaaggaagatgtatagacaacaaaaaagtctgtatcaccctatctacttctctctctcgrcaacggagtggaacgcgggggaaaggaacagacgtgaggggatgacatggagagaaggga

SEQ ID NO: 388 - DNA, 23 bp, Glycine Max
ggctttgtacatgcctgcacggg

SEQ ID NO: 389 - DNA, 22 bp, Glycine Max
tttggaaggccccccgtgcagg

SEQ ID NO: 390 - DNA, 121 bp, Glycine max
ccctcatgttcaaactaggtcaaaaaggctttgcacccatcatcgggtatggaacggttgrcattccaccgttcttgtgaaaaaactcacgttccataactgttcctcatcatctctgatc

SEQ ID NO: 391 - DNA, 121 bp, Glycine max
gttgtggggactgagctggagtggtctccttctctgttgttgctaatgatggtgctggtgytggtggctcctcagtcacaggctcctaggctgtggaggccccaccctctccagaggaaga

SEQ ID NO: 392 - DNA, 23 bp, Glycine Max
ggtttcgtacaacaatggcacgg

SEQ ID NO: 393 - DNA, 23 bp, Glycine Max
gtgccattgttgtacgaaaccgg

SEQ ID NO: 394 - DNA, 121 bp, Glycine max
tacggtttcgcgattttctccaaatttcattttcaaattcaatagactaggctatgacaaygctaggttgtaggcctcggaggtcacgtcattgaagctcatcttcaaagacccgcgctga

SEQ ID NO: 395 - DNA, 121 bp, Glycine max
caagacgtgtccatgcaagaagaaagcaaattgtaacaacaaggcatgaatcaagctaaarcttagttgcacaatgtaaaataggatcaaaggatcataaaaggaactgagagagccgtag

SEQ ID NO: 396 - DNA, 22 bp, Glycine Max
tatatgactaggaaaattcagg

SEQ ID NO: 397 - DNA, 23 bp, Glycine Max
gaattcgattggaccattagtgg

SEQ ID NO: 398 - DNA, 121 bp, Glycine max
ggtctggtgaggtcctatttcactttctagtctctccttcccaaagtatttctttctgtgygcacgtatatgataacttgaatgcaaaaccaaggaaccaaaataacacaaagcaattcca

SEQ ID NO: 399 - DNA, 121 bp, Glycine max
ggctgaaacttgtggaccaatctagtccacaacgggtttgggttgagttaggttgatacaraatattaaccatttaagttatttcaaaagtttgacccgatccactaggttgaactagtga

SEQ ID NO: 400 - DNA, 6518 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgacgagcacacatgtcgattgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 401 - DNA, 6518 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggtgctcgttctcgtgagaagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 402 - DNA, 6518 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgccacttcatttactcaactgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 403 - DNA, 6518 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgactcaaagtcatatttttcgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 404 - DNA, 6550 bp, Artificial
  synthesized sequence
ccgggttaagagaattgtaagtgtgcttttatatatttaaaattaatatattttgaaatgttaaaatataaaagaaaattcaatgtaaattaaaaataaataaatgtttaataaagataaattttaaaacataaaagaaaatgtctaacaagaggattaagatcctgtgctcttaaatttttaggtgttgaaatcttagccatacaaaatatattttattaaaaccaagcatgaaaaaagtcactaaagagctatataactcatgcagctagaaatgaagtgaagggaatccagtttgttctcagtcgaaagagtgtctatctttgttcttttctgcaaccgagttaagcaaaatgggaatgcgaggtatcttcctttcgttaggggagcaccagatgcatagttagtcccacattgatgaatataacaagagcttcacagaatatatagcccaggccacagtaaaagcttgtcccttgtacttgtacgtagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 405 - DNA, 6518 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgtattctagaaaagaggaatgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 406 - DNA, 6518 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggtgctaagcacgacatccagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 407 - DNA, 6518 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgacgtgatgcatcatagatggttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 408 - DNA, 6518 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgaggaaatgactgtggcacagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 409 - DNA, 6518 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgacatggcactgtaacatcagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 410 - DNA, 6550 bp, Artificial
  synthesized sequence
ccgggttaagagaattgtaagtgtgcttttatatatttaaaattaatatattttgaaatgttaaaatataaaagaaaattcaatgtaaattaaaaataaataaatgtttaataaagataaattttaaaacataaaagaaaatgtctaacaagaggattaagatcctgtgctcttaaatttttaggtgttgaaatcttagccatacaaaatatattttattaaaaccaagcatgaaaaaagtcactaaagagctatataactcatgcagctagaaatgaagtgaagggaatccagtttgttctcagtcgaaagagtgtctatctttgttcttttctgcaaccgagttaagcaaaatgggaatgcgaggtatcttcctttcgttaggggagcaccagatgcatagttagtcccacattgatgaatataacaagagcttcacagaatatatagcccaggccacagtaaaagcttggaactgacacacgacatgagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 411 - DNA, 6518 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgacatgatggaacgtgactagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 412 - DNA, 6518 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgtgtgtgaggtacacaattagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 413 - DNA, 6518 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgtaatgtacgttgttgtgtggttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 414 - DNA, 466 bp, Glycine max
ccgggttaagagaattgtaagtgtgcttttatatatttaaaattaatatattttgaaatgttaaaatataaaagaaaattcaatgtaaattaaaaataaataaatgtttaataaagataaattttaaaacataaaagaaaatgtctaacaagaggattaagatcctgtgctcttaaatttttaggtgttgaaatcttagccatacaaaatatattttattaaaaccaagcatgaaaaaagtcactaaagagctatataactcatgcagctagaaatgaagtgaagggaatccagtttgttctcagtcgaaagagtgtctatctttgttcttttctgcaaccgagttaagcaaaatgggaatgcgaggtatcttcctttcgttaggggagcaccagatgcatagttagtcccacattgatgaatataacaagagcttcacagaatatatagcccaggccacagtaaa

SEQ ID NO: 415 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggaaacttttgtgagcaagtgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 416 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggaccaaagacttcattaatgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 417 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggcaacgacaatgaagtgcagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 418 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgccatgcactcacataatcggttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 419 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgacacaatttagttgcctgagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 420 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgaaataaaaggcctataaaagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 421 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgttcaggttgttgtacgacagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 422 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgatgaagacatgaatcattggttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 423 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggcaagttgggttatgaaatgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 424 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgattatgtatgatgcaagttgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 425 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgaccaaaggcacgtacgtaagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 426 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggcctttacgtacgtgccttgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 427 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgatagtcatcctagttagtggttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 428 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgatgtagtaccacactaactgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 429 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgctgtaacttctgcactcacgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 430 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgttattggagagtactttgcgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 431 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgtgagatgtggtgcgtacgtgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 432 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggattcttaaaaaagatcgagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 433 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgtgctatggtgctcgtgtaagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 434 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgatccaagatattgagtgatgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 435 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggctttgtacatgcctgcacgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 436 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgtttggaaggccccccgtgcgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 437 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttggtttcgtacaacaatggcagttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 438 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgtgccattgttgtacgaaacgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 439 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgtatatgactaggaaaattcgttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 440 - DNA, 6599 bp, Artificial
  synthesized sequence
ccgggtgtgatttagtataaagtgaagtaatggtcaaaagaaaaagtgtaaaacgaagtacctagtaataagtaatattgaacaaaataaatggtaaagtgtcagatatataaaataggctttaataaaaggaagaaaaaaaacaaacaaaaaataggttgcaatggggcagagcagagtcatcatgaagctagaaaggctaccgatagataaactatagttaattaaatacattaaaaaatacttggatctttctcttaccctgtttatattgagacctgaaacttgagagagatacactaatcttgccttgttgtttcattccctaacttacaggactcagcgcatgtcatgtggtctcgttccccatttaagtcccacaccgtctaaacttattaaattattaatgtttataactagatgcacaacaacaaagcttgaattcgattggaccattaggttttagagctagaaatagcaagttaaaataaggctagtccgttatcaacttgaaaaagtggcaccgagtcggtgcttttttttgcggccgcaattggatcgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggcaccgaagaagaagcgcaaggtgatggacaaaaagtactcaatagggctcgacatagggactaactccgttggatgggccgtcatcaccgacgagtacaaggtgccctccaagaagttcaaggtgttgggaaacaccgacaggcacagcataaagaagaatttgatcggtgccctcctcttcgactccggagagaccgctgaggctaccaggctcaagaggaccgctagaaggcgctacaccagaaggaagaacagaatctgctacctgcaggagatcttctccaacgagatggccaaggtggacgactccttcttccaccgccttgaggaatcattcctggtggaggaggataaaaagcacgagagacacccaatcttcgggaacatcgtcgacgaggtggcctaccatgaaaagtaccctaccatctaccacctgaggaagaagctggtcgactctaccgacaaggctgacttgcgcttgatttacctggctctcgctcacatgataaagttccgcggacacttcctcattgagggagacctgaacccagacaactccgacgtggacaagctcttcatccagctcgttcagacctacaaccagcttttcgaggagaacccaatcaacgccagtggagttgacgccaaggctatcctctctgctcgtctgtcaaagtccaggaggcttgagaacttgattgcccagctgcctggcgaaaagaagaacggactgttcggaaacttgatcgctctctccctgggattgactcccaacttcaagtccaacttcgacctcgccgaggacgctaagttgcagttgtctaaagacacctacgacgatgacctcgacaacttgctggcccagataggcgaccaatacgccgatctcttcctcgccgctaagaacttgtccgacgcaatcctgctgtccgacatcctgagagtcaacactgagattaccaaagctcctctgtctgcttccatgattaagcgctacgacgagcaccaccaagatctgaccctgctcaaggccctggtgagacagcagctgcccgagaagtacaaggagatctttttcgaccagtccaagaacggctacgccggatacattgacggaggcgcctcccaggaagagttctacaagttcatcaagcccatccttgagaagatggacggtaccgaggagctgttggtgaagttgaacagagaggacctgttgaggaagcagagaaccttcgacaacggaagcatccctcaccaaatccacctgggagagctccacgccatcttgaggaggcaggaggatttctatcccttcctgaaggacaaccgcgagaagattgagaagatcttgaccttcagaattccttactacgtcgggccactcgccagaggaaactctaggttcgcctggatgacccgcaaatctgaagagaccattactccctggaacttcgaggaagtcgtggacaagggcgcttccgctcagtctttcatcgagaggatgaccaacttcgataaaaatctgcccaacgagaaggtgctgcccaagcactccctgttgtacgagtatttcacagtgtacaacgagctcaccaaggtgaagtacgtcacagagggaatgaggaagcctgccttcttgtccggagagcagaagaaggccatcgtcgacctgctcttcaagaccaacaggaaggtgactgtcaagcagctgaaggaggactacttcaagaagatcgagtgcttcgactccgtcgagatctctggtgtcgaggacaggttcaacgcctcccttgggacttaccacgatctgctcaagattattaaagacaaggacttcctggacaacgaggagaacgaggacatccttgaggacatcgtgctcaccctgaccttgttcgaagacagggaaatgatcgaagagaggctcaagacctacgcccacctcttcgacgacaaggtgatgaaacagctgaagagacgcagatataccggctggggaaggctctcccgcaaattgatcaacgggatcagggacaagcagtcagggaagactatactcgacttcctgaagtccgacggattcgccaacaggaacttcatgcagctcattcacgacgactccttgaccttcaaggaggacatccagaaggctcaggtgtctggacagggtgactccttgcatgagcacattgctaacttggccggctctcccgctattaagaagggcattttgcagaccgtgaaggtcgttgacgagctcgtgaaggtgatgggacgccacaagccagagaacatcgttattgagatggctcgcgagaaccaaactacccagaaagggcagaagaattcccgcgagaggatgaagcgcattgaggagggcataaaagagcttggctctcagatcctcaaggagcaccccgtcgagaacactcagctgcagaacgagaagctgtacctgtactacctccaaaacggaagggacatgtacgtggaccaggagctggacatcaacaggttgtccgactacgacgtcgaccacatcgtgcctcagtccttcctgaaggatgactccatcgacaataaagtgctgacacgctccgataaaaatagaggcaagtccgacaacgtcccctccgaggaggtcgtgaagaagatgaaaaactactggagacagctcttgaacgccaagctcatcacccagcgtaagttcgacaacctgactaaggctgagagaggaggattgtccgagctcgataaggccggattcatcaagagacagctcgtcgaaacccgccaaattaccaagcacgtggcccaaattctggattcccgcatgaacaccaagtacgatgaaaatgacaagctgatccgcgaggtcaaggtgatcaccttgaagtccaagctggtctccgacttccgcaaggacttccagttctacaaggtgagggagatcaacaactaccaccacgcacacgacgcctacctcaacgctgtcgttggaaccgccctcatcaaaaaatatcctaagctggagtctgagttcgtctacggcgactacaaggtgtacgacgtgaggaagatgatcgctaagtctgagcaggagatcggcaaggccaccgccaagtacttcttctactccaacatcatgaacttcttcaagaccgagatcactctcgccaacggtgagatcaggaagcgcccactgatcgagaccaacggtgagactggagagatcgtgtgggacaaagggagggatttcgctactgtgaggaaggtgctctccatgcctcaggtgaacatcgtcaagaagaccgaagttcagaccggaggattctccaaggagtccatcctccccaagagaaactccgacaagctgatcgctagaaagaaagactgggaccctaagaagtacggaggcttcgattctcctaccgtggcctactctgtgctggtcgtggccaaggtggagaagggcaagtccaagaagctgaaatccgtcaaggagctcctcgggattaccatcatggagaggagttccttcgagaagaaccctatcgacttcctggaggccaagggatataaagaggtgaagaaggacctcatcatcaagctgcccaagtactccctcttcgagttggagaacggaaggaagaggatgctggcttctgccggagagttgcagaagggaaatgagctcgcccttccctccaagtacgtgaacttcctgtacctcgcctctcactatgaaaagttgaagggctctcctgaggacaacgagcagaagcagctcttcgtggagcagcacaagcactacctggacgaaattatcgagcagatctctgagttctccaagcgcgtgatattggccgacgccaacctcgacaaggtgctgtccgcctacaacaagcacagggataagcccattcgcgagcaggctgaaaacattatccacctgtttaccctcacaaacttgggagcccctgctgccttcaagtacttcgacaccaccattgacaggaagagatacacctccaccaaggaggtgctcgacgcaacactcatccaccaatccatcaccggcctctatgaaacaaggattgacttgtcccagctgggaggcgactctagagccgatcccaagaagaagagaaaggtgaagagaccacgggaccgccacgatggcgagctgggaggccgcaagcgggcaaggtaggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 441 - RNA, 96 nt, Artificial
  synthesized sequence
gacgagcacacaugucgauuguuuuagagcuagaaauagcaaguuaaaauaaggcuaguccguuaucaacuugaaaaaguggcaccgagucggugc

SEQ ID NO: 442 - RNA, 96 nt, Artificial
  synthesized sequence
ggugcucguucucgugagaaguuuuagagcuagaaauagcaaguuaaaauaaggcuaguccguuaucaacuugaaaaaguggcaccgagucggugc

SEQ ID NO: 443 - RNA, 96 nt, Artificial
  synthesized sequence
gccacuucauuuacucaacuguuuuagagcuagaaauagcaaguuaaaauaaggcuaguccguuaucaacuugaaaaaguggcaccgagucggugc

SEQ ID NO: 444 - RNA, 96 nt, Artificial
  synthesized sequence
gacucaaagucauauuuuucguuuuagagcuagaaauagcaaguuaaaauaaggcuaguccguuaucaacuugaaaaaguggcaccgagucggugc

SEQ ID NO: 445 - RNA, 96 nt, Artificial
  synthesized sequence
gucccuuguacuuguacguaguuuuagagcuagaaauagcaaguuaaaauaaggcuaguccguuaucaacuugaaaaaguggcaccgagucggugc

SEQ ID NO: 446 - RNA, 96 nt, Artificial
  synthesized sequence
guauucuagaaaagaggaauguuuuagagcuagaaauagcaaguuaaaauaaggcuaguccguuaucaacuugaaaaaguggcaccgagucggugc

SEQ ID NO: 447 - RNA, 96 nt, Artificial
  synthesized sequence
ggugcuaagcacgacauccaguuuuagagcuagaaauagcaaguuaaaauaaggcuaguccguuaucaacuugaaaaaguggcaccgagucggugc

SEQ ID NO: 448 - RNA, 96 nt, Artificial
  synthesized sequence
gacgugaugcaucauagaugguuuuagagcuagaaauagcaaguuaaaauaaggcuaguccguuaucaacuugaaaaaguggcaccgagucggugc

SEQ ID NO: 449 - RNA, 96 nt, Artificial
  synthesized sequence
gaggaaaugacuguggcacaguuuuagagcuagaaauagcaaguuaaaauaaggcuaguccguuaucaacuugaaaaaguggcaccgagucggugc

SEQ ID NO: 450 - RNA, 96 nt, Artificial
  synthesized sequence
gacauggcacuguaacaucaguuuuagagcuagaaauagcaaguuaaaauaaggcuaguccguuaucaacuugaaaaaguggcaccgagucggugc

SEQ ID NO: 451 - RNA, 96 nt, Artificial
  synthesized sequence
ggaacugacacacgacaugaguuuuagagcuagaaauagcaaguuaaaauaaggcuaguccguuaucaacuugaaaaaguggcaccgagucggugc

SEQ ID NO: 452 - RNA, 96 nt, Artificial
  synthesized sequence
gacaugauggaacgugacuaguuuuagagcuagaaauagcaaguuaaaauaaggcuaguccguuaucaacuugaaaaaguggcaccgagucggugc

SEQ ID NO: 453 - RNA, 96 nt, Artificial
  synthesized sequence
gugugugagguacacaauuaguuuuagagcuagaaauagcaaguuaaaauaaggcuaguccguuaucaacuugaaaaaguggcaccgagucggugc

SEQ ID NO: 454 - RNA, 96 nt, Artificial
  synthesized sequence
guaauguacguuguugugugguuuuagagcuagaaauagcaaguuaaaauaaggcuaguccguuaucaacuugaaaaaguggcaccgagucggugc

SEQ ID NO: 455 - RNA, 96 nt, Artificial
  synthesized sequence
ggaaacuuuugugagcaaguguuuuagagcuagaaauagcaaguuaaaauaaggcuaguccguuaucaacuugaaaaaguggcaccgagucggugc

SEQ ID NO: 456 - RNA, 96 nt, Artificial
  synthesized sequence
ggaccaaagacuucauuaauguuuuagagcuagaaauagcaaguuaaaauaaggcuaguccguuaucaacuugaaaaaguggcaccgagucggugc

SEQ ID NO: 457 - RNA, 96 nt, Artificial
  synthesized sequence
ggcaacgacaaugaagugcaguuuuagagcuagaaauagcaaguuaaaauaaggcuaguccguuaucaacuugaaaaaguggcaccgagucggugc

SEQ ID NO: 458 - RNA, 96 nt, Artificial
  synthesized sequence
gccaugcacucacauaaucgguuuuagagcuagaaauagcaaguuaaaauaaggcuaguccguuaucaacuugaaaaaguggcaccgagucggugc

SEQ ID NO: 459 - RNA, 96 nt, Artificial
  synthesized sequence
gacacaauuuaguugccugaguuuuagagcuagaaauagcaaguuaaaauaaggcuaguccguuaucaacuugaaaaaguggcaccgagucggugc

SEQ ID NO: 460 - RNA, 96 nt, Artificial
  synthesized sequence
gaaauaaaaggccuauaaaaguuuuagagcuagaaauagcaaguuaaaauaaggcuaguccguuaucaacuugaaaaaguggcaccgagucggugc

SEQ ID NO: 461 - RNA, 96 nt, Artificial
  synthesized sequence
guucagguuguuguacgacaguuuuagagcuagaaauagcaaguuaaaauaaggcuaguccguuaucaacuugaaaaaguggcaccgagucggugc

SEQ ID NO: 462 - RNA, 96 nt, Artificial
  synthesized sequence
gaugaagacaugaaucauugguuuuagagcuagaaauagcaaguuaaaauaaggcuaguccguuaucaacuugaaaaaguggcaccgagucggugc

SEQ ID NO: 463 - RNA, 96 nt, Artificial
  synthesized sequence
ggcaaguuggguuaugaaauguuuuagagcuagaaauagcaaguuaaaauaaggcuaguccguuaucaacuugaaaaaguggcaccgagucggugc

SEQ ID NO: 464 - RNA, 96 nt, Artificial
  synthesized sequence
gauuauguaugaugcaaguuguuuuagagcuagaaauagcaaguuaaaauaaggcuaguccguuaucaacuugaaaaaguggcaccgagucggugc

SEQ ID NO: 465 - RNA, 96 nt, Artificial
  synthesized sequence
gaccaaaggcacguacguaaguuuuagagcuagaaauagcaaguuaaaauaaggcuaguccguuaucaacuugaaaaaguggcaccgagucggugc

SEQ ID NO: 466 - RNA, 96 nt, Artificial
  synthesized sequence
ggccuuuacguacgugccuuguuuuagagcuagaaauagcaaguuaaaauaaggcuaguccguuaucaacuugaaaaaguggcaccgagucggugc

SEQ ID NO: 467 - RNA, 96 nt, Artificial
  synthesized sequence
gauagucauccuaguuagugguuuuagagcuagaaauagcaaguuaaaauaaggcuaguccguuaucaacuugaaaaaguggcaccgagucggugc

SEQ ID NO: 468 - RNA, 96 nt, Artificial
  synthesized sequence
gauguaguaccacacuaacuguuuuagagcuagaaauagcaaguuaaaauaaggcuaguccguuaucaacuugaaaaaguggcaccgagucggugc

SEQ ID NO: 469 - RNA, 96 nt, Artificial
  synthesized sequence
gcuguaacuucugcacucacguuuuagagcuagaaauagcaaguuaaaauaaggcuaguccguuaucaacuugaaaaaguggcaccgagucggugc

SEQ ID NO: 470 - RNA, 96 nt, Artificial
  synthesized sequence
guuauuggagaguacuuugcguuuuagagcuagaaauagcaaguuaaaauaaggcuaguccguuaucaacuugaaaaaguggcaccgagucggugc

SEQ ID NO: 471 - RNA, 96 nt, Artificial
  synthesized sequence
gugagauguggugcguacguguuuuagagcuagaaauagcaaguuaaaauaaggcuaguccguuaucaacuugaaaaaguggcaccgagucggugc

SEQ ID NO: 472 - RNA, 96 nt, Artificial
  synthesized sequence
ggauucuuaaaaaagaucgaguuuuagagcuagaaauagcaaguuaaaauaaggcuaguccguuaucaacuugaaaaaguggcaccgagucggugc

SEQ ID NO: 473 - RNA, 96 nt, Artificial
  synthesized sequence
gugcuauggugcucguguaaguuuuagagcuagaaauagcaaguuaaaauaaggcuaguccguuaucaacuugaaaaaguggcaccgagucggugc

SEQ ID NO: 474 - RNA, 96 nt, Artificial
  synthesized sequence
gauccaagauauugagugauguuuuagagcuagaaauagcaaguuaaaauaaggcuaguccguuaucaacuugaaaaaguggcaccgagucggugc

SEQ ID NO: 475 - RNA, 96 nt, Artificial
  synthesized sequence
ggcuuuguacaugccugcacguuuuagagcuagaaauagcaaguuaaaauaaggcuaguccguuaucaacuugaaaaaguggcaccgagucggugc

SEQ ID NO: 476 - RNA, 96 nt, Artificial
  synthesized sequence
guuuggaaggccccccgugcguuuuagagcuagaaauagcaaguuaaaauaaggcuaguccguuaucaacuugaaaaaguggcaccgagucggugc

SEQ ID NO: 477 - RNA, 96 nt, Artificial
  synthesized sequence
gguuucguacaacaauggcaguuuuagagcuagaaauagcaaguuaaaauaaggcuaguccguuaucaacuugaaaaaguggcaccgagucggugc

SEQ ID NO: 478 - RNA, 96 nt, Artificial
  synthesized sequence
gugccauuguuguacgaaacguuuuagagcuagaaauagcaaguuaaaauaaggcuaguccguuaucaacuugaaaaaguggcaccgagucggugc

SEQ ID NO: 479 - RNA, 96 nt, Artificial
  synthesized sequence
guauaugacuaggaaaauucguuuuagagcuagaaauagcaaguuaaaauaaggcuaguccguuaucaacuugaaaaaguggcaccgagucggugc

SEQ ID NO: 480 - RNA, 96 nt, Artificial
  synthesized sequence
gaauucgauuggaccauuagguuuuagagcuagaaauagcaaguuaaaauaaggcuaguccguuaucaacuugaaaaaguggcaccgagucggugc

SEQ ID NO: 481 - DNA, 22 bp, Artificial
  synthesized sequence
gagaacgagcacacatgtcgat

SEQ ID NO: 482 - DNA, 23 bp, Artificial
  synthesized sequence
ggtttagtttggcgttggtaaaa

SEQ ID NO: 483 - DNA, 19 bp, Artificial
  synthesized sequence
tggtttcaatctaagaatg

SEQ ID NO: 484 - DNA, 26 bp, Artificial
  synthesized sequence
aaccaaataaactccattctcacgag

SEQ ID NO: 485 - DNA, 26 bp, Artificial
  synthesized sequence
atctgccacttcatttactcaacttg

SEQ ID NO: 486 - DNA, 31 bp, Artificial
  synthesized sequence
tgtatggtgtcaagtatgaagtttatagtga

SEQ ID NO: 487 - DNA, 18 bp, Artificial
  synthesized sequence
agctttctctcatcaaaa

SEQ ID NO: 488 - DNA, 29 bp, Artificial
  synthesized sequence
tactacaactcaaagtcatatttttcagg

SEQ ID NO: 489 - DNA, 26 bp, Artificial
  synthesized sequence
ttctagaataccctccgtacgtacaa

SEQ ID NO: 490 - DNA, 26 bp, Artificial
  synthesized sequence
cccagatgattctcttttcactattg

SEQ ID NO: 491 - DNA, 19 bp, Artificial
  synthesized sequence
caagggacttgtgagttgt

SEQ ID NO: 492 - DNA, 26 bp, Artificial
  synthesized sequence
aaagaagaggcagactccaattcctc

SEQ ID NO: 493 - DNA, 26 bp, Artificial
  synthesized sequence
tccattttgtctgttctccatggatg

SEQ ID NO: 494 - DNA, 23 bp, Artificial
  synthesized sequence
cacattgtcccagtcacagaaag

SEQ ID NO: 495 - DNA, 16 bp, Artificial
  synthesized sequence
agatgcggtaaattat

SEQ ID NO: 496 - DNA, 22 bp, Artificial
  synthesized sequence
acgtgatgcatcatagatgcgg

SEQ ID NO: 497 - DNA, 23 bp, Artificial
  synthesized sequence
agtgttctggcacaaggtttacc

SEQ ID NO: 498 - DNA, 16 bp, Artificial
  synthesized sequence
ctcctccagtggccac

SEQ ID NO: 499 - DNA, 23 bp, Artificial
  synthesized sequence
tccctgaaatttgtggttggtaa

SEQ ID NO: 500 - DNA, 22 bp, Artificial
  synthesized sequence
tactaggaaatgactgtggcac

SEQ ID NO: 501 - DNA, 18 bp, Artificial
  synthesized sequence
catggcgtaacccgtgat

SEQ ID NO: 502 - DNA, 27 bp, Artificial
  synthesized sequence
cccttttaaggaaaaaaactacgtcat

SEQ ID NO: 503 - DNA, 20 bp, Artificial
  synthesized sequence
acatggcactgtaacatcac

SEQ ID NO: 504 - DNA, 19 bp, Artificial
  synthesized sequence
ccctgaaatttgtggttgg

SEQ ID NO: 505 - DNA, 22 bp, Artificial
  synthesized sequence
attcggaactgacacacgacat

SEQ ID NO: 506 - DNA, 22 bp, Artificial
  synthesized sequence
tcgacatgcaaagtcaaaaacc

SEQ ID NO: 507 - DNA, 17 bp, Artificial
  synthesized sequence
atggaacgtgactaagg

SEQ ID NO: 508 - DNA, 27 bp, Artificial
  synthesized sequence
cgataacgagaaggagatacataaggt

SEQ ID NO: 509 - DNA, 24 bp, Artificial
  synthesized sequence
tgaacttcttcatccccataattg

SEQ ID NO: 510 - DNA, 18 bp, Artificial
  synthesized sequence
cgttgttgtgtgaggtac

SEQ ID NO: 511 - DNA, 21 bp, Artificial
  synthesized sequence
ccaaaggcacgtacgtaaagg

SEQ ID NO: 512 - DNA, 23 bp, Artificial
  synthesized sequence
ttgcaattgtgcactgttttttt

SEQ ID NO: 513 - DNA, 18 bp, Artificial
  synthesized sequence
agcacatgttctaatgaa

SEQ ID NO: 514 - DNA, 23 bp, Artificial
  synthesized sequence
cacacacaaaaattaccaaaggc

SEQ ID NO: 515 - DNA, 23 bp, Artificial
  synthesized sequence
tttggtgtccacagaatattcga

SEQ ID NO: 516 - DNA, 28 bp, Artificial
  synthesized sequence
ctttaatgcattgttttggatagtcatc

SEQ ID NO: 517 - DNA, 22 bp, Artificial
  synthesized sequence
agatgtagtaccacactaacta

SEQ ID NO: 518 - DNA, 19 bp, Artificial
  synthesized sequence
ctgcactcaccggcaaagt

SEQ ID NO: 519 - DNA, 25 bp, Artificial
  synthesized sequence
acctctctatcccttctttcttcgt

SEQ ID NO: 520 - DNA, 21 bp, Artificial
  synthesized sequence
ctctccaataaagagaataga

SEQ ID NO: 521 - DNA, 25 bp, Artificial
  synthesized sequence
aagtgagatgtggtgcgtacgtagg

SEQ ID NO: 522 - DNA, 27 bp, Artificial
  synthesized sequence
ggtttgtggctataacttgagagaatg

SEQ ID NO: 523 - DNA, 23 bp, Artificial
  synthesized sequence
attcttaaaaaagatcgaaggac

SEQ ID NO: 524 - DNA, 22 bp, Artificial
  synthesized sequence
gaattcaggtcggatccaagat

SEQ ID NO: 525 - DNA, 22 bp, Artificial
  synthesized sequence
gtgctatggtgctcgtgtaagg

SEQ ID NO: 526 - DNA, 17 bp, Artificial
  synthesized sequence
tgagtgatcggagtttc

SEQ ID NO: 527 - DNA, 24 bp, Artificial
  synthesized sequence
caacaccaacaccctttctaacag

SEQ ID NO: 528 - DNA, 17 bp, Artificial
  synthesized sequence
aaggccccccgtgcagg

SEQ ID NO: 529 - DNA, 15 bp, Artificial
  synthesized sequence
agcatcaaaattggc

SEQ ID NO: 530 - DNA, 24 bp, Artificial
  synthesized sequence
ccccggtttcgtacaacaatggca

SEQ ID NO: 531 - DNA, 26 bp, Artificial
  synthesized sequence
catcctcgctactctctaagacaatg

SEQ ID NO: 532 - DNA, 16 bp, Artificial
  synthesized sequence
cttgatctcaattccg

SEQ ID NO: 533 - DNA, 22 bp, Artificial
  synthesized sequence
aatctattatcccccggtttcg

SEQ ID NO: 534 - DNA, 25 bp, Artificial
  synthesized sequence
ccctatatgactaggaaaattcagg

SEQ ID NO: 535 - DNA, 23 bp, Artificial
  synthesized sequence
gctacatttggttgggtcacttg

SEQ ID NO: 536 - DNA, 17 bp, Artificial
  synthesized sequence
tcggtccctatgcctat

SEQ ID NO: 537 - DNA, 23 bp, Artificial
  synthesized sequence
caggtacggaccaccactaatgg

SEQ ID NO: 538 - DNA, 27 bp, Artificial
  synthesized sequence
gaaacttttgtgagcaagtaggtagct

SEQ ID NO: 539 - DNA, 23 bp, Artificial
  synthesized sequence
atggcaagaacaagaccaaagac

SEQ ID NO: 540 - DNA, 21 bp, Artificial
  synthesized sequence
agagtcaagaccaattaatga

SEQ ID NO: 541 - DNA, 22 bp, Artificial
  synthesized sequence
atgaagtgtgagtgggcaagtg

SEQ ID NO: 542 - DNA, 19 bp, Artificial
  synthesized sequence
gtcctcaccgccatgcact

SEQ ID NO: 543 - DNA, 18 bp, Artificial
  synthesized sequence
cgtttcttccacgattat

SEQ ID NO: 544 - DNA, 22 bp, Artificial
  synthesized sequence
gcgtttcttccacgattatgtg

SEQ ID NO: 545 - DNA, 15 bp, Artificial
  synthesized sequence
tggccgcaacgacaa

SEQ ID NO: 546 - DNA, 28 bp, Artificial
  synthesized sequence
attattacacaatttagttgcctgacgg

SEQ ID NO: 547 - DNA, 26 bp, Artificial
  synthesized sequence
tgtggtgatagatccccttttatagg

SEQ ID NO: 548 - DNA, 22 bp, Artificial
  synthesized sequence
tttttttcatccaaccttgtca

SEQ ID NO: 549 - DNA, 23 bp, Artificial
  synthesized sequence
ggttcaggttgttgtacgacatg

SEQ ID NO: 550 - DNA, 29 bp, Artificial
  synthesized sequence
gttgaatggtatgatgttactgagcttat

SEQ ID NO: 551 - DNA, 20 bp, Artificial
  synthesized sequence
ttgtggatacggtagttgtg

SEQ ID NO: 552 - DNA, 29 bp, Artificial
  synthesized sequence
ttattgtatgaagacatgaatcattgagg

SEQ ID NO: 553 - DNA, 23 bp, Artificial
  synthesized sequence
gtgccatttgcccattatgtatg

SEQ ID NO: 554 - DNA, 29 bp, Artificial
  synthesized sequence
cttgttggtacttcatgctagtagatttc

SEQ ID NO: 555 - DNA, 24 bp, Artificial
  synthesized sequence
tgcaagttgggttatgaaattggt

SEQ ID NO: 556 - DNA, 23 bp, Artificial
  synthesized sequence
cattatgtatgatgcaagttggg

SEQ ID NO: 557 - DNA, 24 bp, Artificial
  synthesized sequence
catgggttatgatcctcaaagtca

SEQ ID NO: 558 - DNA, 17 bp, Artificial
  synthesized sequence
agctacgtgatctgatg

SEQ ID NO: 559 - DNA, 19 bp, Artificial
  synthesized sequence
ccttcttccaccgccttga

SEQ ID NO: 560 - DNA, 21 bp, Artificial
  synthesized sequence
tgggtgtctctcgtgcttttt

SEQ ID NO: 561 - DNA, 19 bp, Artificial
  synthesized sequence
aatcattcctggtggagga

SEQ ID NO: 562 - DNA, 25 bp, Artificial
  synthesized sequence
tgatgcccacattatagtgattagc

SEQ ID NO: 563 - DNA, 22 bp, Artificial
  synthesized sequence
catcttctggattggccaactt

SEQ ID NO: 564 - DNA, 17 bp, Artificial
  synthesized sequence
actatgtgtgcatcctt

SEQ ID NO: 565 - DNA, 22 bp, Artificial
  synthesized sequence
aggcttgttgtgcagtttttga

SEQ ID NO: 566 - DNA, 21 bp, Artificial
  synthesized sequence
gcggtgagttcaggctttttc

SEQ ID NO: 567 - DNA, 22 bp, Artificial
  synthesized sequence
tggactagtggaagttcctata

SEQ ID NO: 568 - DNA, 23 bp, Artificial
  synthesized sequence
ttcaagttgggctttttcagaag

SEQ ID NO: 569 - DNA, 22 bp, Artificial
  synthesized sequence
tctccttggtgctctcatcaca

SEQ ID NO: 570 - DNA, 15 bp, Artificial
  synthesized sequence
ctgcagcagaaccaa

SEQ ID NO: 571 - DNA, 3387 bp, S. thermophilus
atgagtgacttagttttaggacttgatatcggtataggttctgttggtgtaggtatccttaacaaagtgacaggagaaattatccataaaaactcacgcatcttcccagcagctcaagcagaaaataacctagtacgtagaacgaatcgtcaaggaagacgcttgacacgacgtaaaaaacatcgtatagttcgtttaaatcgtctatttgaggaaagtggattaatcaccgattttacgaagatttcaattaatcttaacccatatcaattacgagttaagggcttgaccgatgaattgtctaatgaagaactgtttatcgctcttaaaaatatggtgaaacaccgtgggattagttacctcgatgatgctagtgatgacggaaattcatcagtaggagactatgcacaaattgttaaggaaaatagtaaacaattagaaactaagacaccgggacagatacagttggaacgctaccaaacatatggtcaattacgtggtgattttactgttgagaaagatggcaaaaaacatcgcttgattaatgtctttccaacatcagcttatcgttcagaagccttaaggatactgcaaactcaacaagaatttaatccacagattacagatgaatttattaatcgttatctcgaaattttaactggaaaacggaaatattatcatggacccggaaatgaaaagtcacggactgattatggtcgttacagaacgagtggagaaactttagacaatatttttggaattctaattgggaaatgtacattttatccagaagagtttagagcagcaaaagcttcctacacggctcaagaattcaatttgctaaatgatttgaacaatctaacagttcctactgaaaccaaaaagttgagcaaagaacagaagaatcaaatcattaattatgtcaaaaatgaaaaggcaatggggccagcgaaactttttaaatatatcgctaagttactttcttgtgatgttgcagatatcaagggataccgtatcgacaaatcaggtaaggctgagattcatactttcgaagcctatcgaaaaatgaaaacgcttgaaaccttagatattgaacaaatggatagagaaacgcttgataaattagcctatgtcttaacattaaacactgagagggaaggtattcaagaagccttagaacatgaatttgctgatggtagctttagccagaagcaagttgacgaattggttcaattccgcaaagcaaatagttccatttttggaaaaggatggcataatttttctgtcaaactgatgatggagttaattccagaattgtatgagacgtcagaagagcaaatgactatcctgacacgacttggaaaacaaaaacgacttcgtcttcaaataaaacaaaatatttcaaataaaacaaaatatatagatgagaaactattaactgaagaaatctataatcctgttgttgctaagtctgttcgccaggctataaaaatcgtaaatgcggcgattaaagaatacggagactttgacaatattgtcatcgaaatggctcgtgaaacaaatgaagatgatgaaaagaaagctattcaaaagattcaaaaagccaacaaagatgaaaaagatgcagcaatgcttaaggctgctaaccaatataatggaaaggctgaattaccacatagtgttttccacggtcataagcaattagcgactaaaatccgcctttggcatcagcaaggagaacgttgcctttatactggtaagacaatctcaatccatgatttgataaataatcctaatcagtttgaagtagatcatattttacctctttctatcacattcgatgatagccttgcaaataaggttttggtttatgcaactgctaaccaagaaaaaggacaacgaacaccttatcaggctttagatagtatggatgatgcgtggtctttccgtgaattaaaagcttttgtacgtgagtcaaaaacactttcaaacaagaaaaaagaatacctccttacagaagaagatatttcaaagtttgatgttcgaaagaaatttattgaacgaaatcttgtagatacaagatacgcttcaagagttgtcctcaatgcccttcaagaacactttagagctcacaagattgatacaaaagtttccgtggttcgtggccaatttacatctcaattgagacgccattggggaattgagaagactcgtgatacttatcatcaccatgctgtcgatgcattgattattgccgcctcaagtcagttgaatttgtggaaaaaacaaaagaatacccttgtaagttattcagaagaacaactccttgatattgaaacaggtgaacttattagtgatgatgagtacaaggaatctgtgttcaaagccccttatcaacattttgttgatacattgaagagtaaagaatttgaagacagtatcttattctcatatcaagtggattctaagtttaatcgtaaaatatcagatgccactatttatgcgacaagacaggctaaagtgggaaaagataagaaggatgaaacttatgtcttagggaaaatcaaagatatctatactcaggatggttatgatgcctttatgaagatttataagaaggataagtcaaaattcctcatgtatcgtcacgacccacaaacctttgagaaagttatcgagccaattttagagaactatcctaataagcaaatgaatgaaaaaggaaaagaggtaccatgtaatcctttcctaaaatataaagaagaacatggctatattcgtaaatatagtaaaaaaggcaatggtcctgaaatcaagagtcttaaatactatgatagtaagcttttaggtaatcctattgatattactccagagaatagtaaaaataaagttgtcttacagtcattaaaaccttggagaacagatgtctatttcaataaggctactggaaaatacgaaatccttggattaaaatatgctgatctacaatttgagaaagggacaggaacatataagatttcccaggaaaaatacaatgacattaagaaaaaagagggtgtagattctgattcagaattcaagtttacactttataaaaatgatttgttactcgttaaagatacagaaacaaaagaacaacagcttttccgttttctttctcgaactttacctaaacaaaagcattatgttgaattaaaaccttatgataaacagaaatttgaaggaggtgaggcgttaattaaagtgttgggtaacgttgctaatggtggtcaatgcataaaaggactagcaaaatcaaatatttctatttataaagtaagaacagatgtcctaggaaatcagcatatcatcaaaaatgagggtgataagcctaagctagatttttaa

SEQ ID NO: 572 - DNA, 3369 bp, S. thermophilus
atgagtgacttagttttaggacttgatatcggtataggttctgttggtgtaggtatccttaacaaagtgacaggagaaattatccataaaaactcacgcatcttcccagcagctcaagcagaaaataacctagtacgtagaacgaatcgtcaaggaagacgcttgacacgacgtaaaaaacatcgtatagttcgtttaaatcgtctatttgaggaaagtggattaatcaccgattttacgaagatttcaattaatcttaacccatatcaattacgagttaagggcttgaccgatgaattgtctaatgaagaactgtttatcgctcttaaaaatatggtgaaacaccgtgggattagttacctcgatgatgctagtgatgacggaaattcatcagtaggagactatgcacaaattgttaaggaaaatagtaaacaattagaaactaagacaccgggacagatacagttggaacgctaccaaacatatggtcaattacgtggtgattttactgttgagaaagatggcaaaaaacatcgcttgattaatgtctttccaacatcagcttatcgttcagaagccttaaggatactgcaaactcaacaagaatttaattcacagattacagatgaatttattaatcgttatctcgaaattttaactggaaaacggaaatattatcatggacccggaaatgaaaagtcacggactgattatggtcgttacagaacgaatggagaaactttagacaatatttttggaattctaattgggaaatgtacattttatccagacgagtttagagcagcaaaagcttcctacacggctcaagaattcaatttgctaaatgatttgaacaatctaacagttcctactgaaaccaaaaagttgagcaaagaacagaagaatcaaatcattaattatgtcaaaaatgaaaaggtaatggggccagcgaaactttttaaatatatcgctaaattactttcttgtgatgttgcagatatcaagggacaccgtatcgacaaatcaggtaaggctgagattcatactttcgaagcctatcgaaaaatgaaaacgcttgaaaccttagatattgagcaaatggatagagaaacgcttgataaattagcctatgtcttaacattaaacactgagagggaaggtattcaagaagctttagaacatgaatttgctgatggtagctttagccagaagcaagttgacgaattggttcaattccgcaaagcaaatagttccatttttggaaaaggatggcataatttttctgtcaaactgatgatggagttaattccagaattgtatgagacgtcagaagagcaaatgactatcctgacacgacttggaaaacaaaaaacaacttcgtcttcaaataaaacaaaatatatagatgagaaactattaactgaagaaatctataatcctgttgttgctaagtctgttcgccaggctataaaaatcgtaaatgcggcgattaaagaatacggagactttgacaatattgtcatcgaaatggctcgtgaaacaaatgaagatgatgaaaagaaagctattcaaaagattcaaaaagccaacaaagatgaaaaagatgcagcaatgcttaaggctgctaaccaatataatggaaaggctgaattaccacatagtgttttccacggtcataagcaattagcgactaaaatccgcctttggcatcagcaaggagaacgttgcctttatactggtaagacaatctcaatccatgatttgataaataatcctaatcagtttgaagtagatcatattttacctctttctatcacattcgatgatagccttgcaaataaggttttggtttatgcaactgctaaccaagaaaaaggacaacgaacaccttatcaggctttagatagtatggatgatgcgtggtctttccgtgaattaaaagcttttgtacgtgagtcaaaaacactttcaaacaagaaaaaagaatacctccttacagaagaagatatttcaaagtttgatgttcgaaagaaatttattgaacgaaatcttgtagatacaagatacgcttcaagagttgtcctcaatgcccttcaagaacactttagagctcacaagattgatacaaaagtttccgtggttcgtggccaatttacatctcaattgagacgccattggggaattgagaagactcgtgatacttatcatcaccatgctgtcgatgcattgattattgccgcctcaagtcagttgaatttgtggaaaaaacaaaagaatacccttgtaagttattcagaagaacaactccttgatattgaaacaggtgaacttattagtgatgatgagtacaaggaatctgtgttcaaagccccttatcaacattttgttgatacattgaagagtaaagaatttgaagacagtatcttattctcatatcaagtggattctaagtttaatcgtaaaatatcagatgccactatttatgcgacaagacaggctaaagtgggaaaagataagaaggatgaaacttatgtcttagggaaaatcaaagatatctatactcaggatggttatgatgcctttatgaagatttataagaaggataagtcaaaattcctcatgtatcgtcacgacccacaaacctttgagaaagttatcgagccaattttagagaactatcctaataaggaaatgaatgaaaaagggaaagaagtaccatgtaatcctttcctaaaatataaagaagaacatggctatattcgtaaatatagtaaaaaaggcaatggtcctgaaatcaagagtcttaaatactatgatagtaagcttttaggtaatcctattgatattactccagagaatagtaaaaataaagttgtcttacagtcattaaaaccttggagaacagatgtctatttcaataaaaatactggtaaatatgaaattttaggactgaaatatgctgatttacaatttgaaaagaagacaggaacatataagatttcccaggaaaaatacaatggcattatgaaagaagagggtgtagattctgattcagaattcaagtttacactttataaaaatgatttgttactcgttaaagatacagaaacaaaagaacaacagcttttccgttttctttctcgaactatgcctaatgtgaaatattatgtagagttaaagccttattcaaaagataaatttgagaagaatgagtcacttattgaaattttaggttctgcagataagtcaggacgatgtataaaagggctaggaaaatcaaatatttctatttataaggtaagaacagatgtcctaggaaatcagcatatcatcaaaaatgagggtgataagcctaagctagatttttaa

SEQ ID NO: 573 - DNA, 4113 bp, S. agalactiae
atgaataagccatattcaataggccttgacatcggtactaattccgtcggatggagcattattacagatgattataaagtacctgctaagaagatgagagttttagggaacactgataaagaatatattaagaagaatctcataggtgctctgctttttgatggcgggaatactgctgcagatagacgcttgaagcgaactgctcgtcgtcgttatacacgtcgtagaaatcgtattctatatttacaagaaatttttgcagaggaaatgagtaaagttgatgatagtttctttcatcgattagaggattcttttctagttgaggaagataagagagggagcaagtatcctatctttgcaacattgcaggaagagaaagattatcatgaaaaattttcgacaatctatcatttgagaaaagaattagctgacaagaaagaaaaagcagaccttcgtcttatttatattgctctagctcatatcattaaatttagagggcatttcctaattgaggatgatagctttgatgtcaggaatacagacatttcaaaacaatatcaagattttttagaaatctttaatacaacttttgaaaataatgatttgttatctcaaaacgttgacgtagaggcaatactaacagataagattagcaagtctgcgaagaaagatcgtattttagcgcagtatcctaaccaaaaatctactggcatttttgcagaatttttgaaattgattgtcggaaatcaagctgacttcaagaaatatttcaatttggaggataaaacgccgcttcaattcgctaaggatagctacgatgaagatttagaaaatcttcttggacagattggtgatgaatttgcagacttattctcagcagcgaaaaagttatatgatagtgtccttttgtctggcattcttacagtaatcgacctcagtaccaaggcgccactttcagcttctatgattcagcgttatgatgaacatagagaggacttgaaacagttaaaacaattcgtaaaagcttcattgccggaaaaatatcaagaaatatttgctgattcatcaaaagatggctacgctggttatattgaaggtaaaactaatcaagaagctttttataaatacctgtcaaaattgttgaccaagcaagaagatagcgagaattttcttgaaaaaatcaagaatgaagatttcttgagaaaacaaaggacctttgataatggctcaattccacaccaagtccatttgacagagctgaaagctattatccgccgtcaatcagaatactatcccttcttgaaagagaatcaagataggattgaaaaaatccttacctttagaattccttattatatcgggccactagcacgtgagaagagtgattttgcatggatgactcgcaaaacagatgacagtattcgaccttggaattttgaagacttggttgataaagaaaaatctgcggaagcttttatccatcgtatgaccaacaatgatttttatcttcctgaagaaaaagttttaccaaagcatagtcttatttatgaaaaatttacggtctataatgagttgactaaggttagatataaaaatgagcaaggtgagacttatttttttgatagcaatattaaacaagaaatctttgatggagtattcaaggaacatcgtaaggtatccaagaagaagttgctagattttctggctaaagaatatgaggagtttaggatagtagatgttattggtctagataaagaaaataaagctttcaacgcctcattgggaacttaccacgatctcgaaaaaatactagacaaagattttctagataatccagataatgagtctattctggaagatatcgtccaaactctaacattatttgaagacagagaaatgattaagaagcgtcttgaaaactataaagatctttttacagagtcacaactaaaaaaactctatcgtcgtcactatactggctggggacgattgtctgctaagttaatcaatggtattcgagataaagagagtcaaaaaacaatcttggactatcttattgatgatggtagatctaatcgcaactttatgcagttgataaatgatgatggtctatctttcaaatcaattatcagtaaggcacaggctggtagtcattcagataatctaaaagaagttgtaggtgagcttgcaggtagccctgctattaaaaagggaattctacaaagtttgaaaattgttgatgagcttgttaaagtcatgggatacgaacctgaacaaattgtggttgagatggcgcgtgagaatcaaacaacaaatcaaggtcgtcgtaactctcgacaacgctataaacttcttgatgatggcgttaagaatctagctagtgacttgaatggcaatattttgaaagaatatcctacggataatcaagcgttgcaaaatgaaagacttttcctttactacttacaaaacggaagagatatgtatacaggggaagctctagatattgacaatttaagtcaatatgatattgaccacattattcctcaagctttcataaaagatgattctattgataatcgtgttttggtatcatctgctaaaaatcgtggaaagtcagatgatgttcctagccttgaaattgtaaaagattgtaaagttttctggaaaaaattacttgatgctaagttaatgagtcagcgtaagtatgataatttgactaaggcagagcgcggaggcctaacttccgatgataaggcaagatttatccaacgtcagttggttgagacacgacaaattaccaagcatgttgcccgtatcttggatgaacgctttaataatgagcttgatagtaaaggtagaaggatccgcaaagttaaaattgtaaccttgaagtcaaatttggtttcaaatttccgaaaagaatttggattctataaaattcgtgaagttaacaattatcaccatgcacatgatgcctatcttaatgcagtagttgctaaagctattctaaccaaatatcctcagttagagccagaatttgtctacggcgactatccaaaatataatagttacaaaacgcgtaaatccgctacagaaaagctatttttctattcaaatattatgaacttctttaaaactaaggtaactttagcggatggaaccgttgttgtaaaagatgatattgaagttaataatgatacgggtgaaattgtttgggataaaaagaaacactttgcgacagttagaaaagtcttgtcataccctcagaacaatatcgtgaagaagacagagattcagacaggtggtttctctaaggaatcaatcttggcgcatggtaactcagataagttgattccaagaaaaacgaaggatatttatttagatcctaagaaatatggaggttttgatagtccgatagtagcttactctgttttagttgtagctgatatcaaaaagggtaaagcacaaaaactaaaaacagttacggaacttttaggaattaccatcatggagaggtccagatttgagaaaaatccatcagctttccttgaatcaaaaggctatttaaatattagggctgataaactaattattttgcccaagtatagtctgttcgaattagaaaatgggcgtcgtcgattacttgctagtgctggtgaattacaaaaaggtaatgagctagccttaccaacacaatttatgaagttcttataccttgcaagtcgttataatgagtcaaaaggtaaaccagaggagattgagaagaaacaagaatttgtaaatcaacatgtctcttattttgatgacatccttcaattaattaatgatttttcaaaacgagttattctagcagatgctaatttagagaaaatcaataagctttaccaagataataaggaaaatatatcagtagatgaacttgctaataatattatcaatctatttacttttaccagtctaggagctccagcagcttttaaattttttgataaaatagttgatagaaaacgctatacatcaactaaagaagtacttaattctaccctaattcatcaatctattactggactttatgaaacacgtattgatttgggtaagttaggagaagattga

SEQ ID NO: 574 - DNA, 4134 bp, S. agalactiae
atgaataagccatattcaataggccttgacatcggtactaattccgtcggatggagcattattacagatgattataaagtacctgctaagaagatgagagttttagggaacactgataaagaatatattaagaagaatctcataggtgctctgctttttgatggcgggaatactgctgcagatagacgcttgaagcgaactgctcgtcgtcgttatacacgtcgtagaaatcgtattctatatttacaagaaatttttgcagaggaaatgagtaaagttgatgatagtttctttcatcgattagaggattcttttctagttgaggaagataagagaggtagcaagtatcctatctttgcaacaatgcaggaggagaaatattatcatgaaaaatttccgacaatctatcatttgagaaaagaattggctgacaagaaagaaaaagcagaccttcgtcttgtttatctggctctagctcatatcattaaattcagagggcatttcctaattgaggatgatagatttgatgtgaggaataccgatattcaaaaacaatatcaagcctttttagaaatttttgatactacctttgaaaataatcatttgttatctcaaaatgtagatgtagaagcaattctaacagataagattagcaagtctgcgaagaaggatcgcatcttagcgcagtatcctaaccaaaaatctactggtatttttgcagaatttttgaaattgattgtcggaaatcaagctgacttcaagaaacatttcaatttggaggataaaacaccgcttcaattcgctaaggatagctacgatgaagatttagaaaatcttcttggacagattggtgatgaatttgcagacttattctcagtagcgaaaaagctatatgatagtgttcttttatctggcattcttacagtaactgatctcagtaccaaggcgccactttctgcctctatgattcagcgttatgatgaacatcatgaggacttaaagcatctaaaacaattcgtaaaagcttcattacctgaaaattatcgggaagtatttgctgattcatcaaaagatggctacgctggctatattgaaggcaaaactaatcaagaagctttttataaatatctgttaaaattgttgaccaaacaagaaggtagcgagtattttcttgagaaaattaagaatgaagattttttgagaaaacagagaacctttgataatggctcaatcccgcatcaagtccatttgacagaattgagggctattattcgacgtcaatcagaatactatccattcttgaaagagaatcaagataggattgaaaaaatccttacctttagaattccttattatgtcgggccactagcacgtgagaagagtgattttgcatggatgactcgcaaaacagatgacagtattcgaccttggaattttgaagacttggttgataaagaaaaatctgcggaagcttttatccatcgcatgaccaacaatgacctctatcttccagaagaaaaagttttaccaaagcatagtcttatttatgaaaaatttactgtttacaatgaattaacgaaggttagatttttggcagaaggctttaaagattttcaatttttaaataggaagcaaaaagaaactatctttaacagcttgtttaaggaaaaacgtaaagtaactgaaaaggatattattagttttttgaataaagttgatggatatgaaggaattgcaatcaaaggaattgagaaacagtttaacgctagcctttcaacctatcatgatcttaaaaaaatacttggcaaggatttccttgataatacagataacgagcttattttggaagatatcgtccaaactctaaccttatttgaagatagagaaatgattaagaagtgtcttgacatctataaagatttttttacagagtcacagcttaaaaagctctatcgccgtcactatactggctggggacgattgtctgctaagctaataaatggcatccgaaataaagagaatcaaaaaacaatcttggactatcttattgatgatggaagtgcaaaccgaaacttcatgcagttgataaatgatgatgatctatcatttaaaccaattattgacaaggcacgaactggtagtcattcggataatctgaaagaagttgtaggtgaacttgctggtagccctgctattaaaaaagggattctacaaagtttgaaaatagttgatgagctggttaaagtcatgggctatgaacctgaacaaatcgtggttgaaatggcacgtgagaaccaaacgacagcaaaaggattaagtcgttcacgacaacgcttgacaaccttgagagaatctcttgctaatttgaagagtaatattttggaagagaaaaagcctaagtatgtgaaagatcaagttgaaaatcatcatttatctgatgaccgtcttttcctttactacttacaaaacggaagagatatgtatacaaaaaaggctctggatattgataatttaagtcaatatgatattgaccacattattcctcaagctttcataaaagatgattctattgataatcgtgttttggtatcatctgctaaaaatcgtggaaaatcagatgatgttcctagcattgaaattgtaaaagctcgcaaaatgttctggaaaaatttactggatgctaagttaatgagtcagcgtaagtatgataatttgactaaggcagagcgcggaggcctaacttccgatgataaggcaagatttatccaacgtcagttggttgagactcgacaaattaccaagcatgtagctcgtatcttggatgaacgcttcaataatgaagttgataatggtaaaaagatttgcaaggttaaaattgtaaccttgaagtcaaatttggtttcaaatttccgaaaagaatttggattctataaaattcgtgaagttaatgattatcaccatgcacacgatgcttatcttaatgcagtagttgccaaagctattctaaccaaatatccacagttagagccagagtttgtctacggaatgtatagacagaaaaaactttcgaaaatcgttcatgaggataaggaagaaaaatatagtgaagcaaccaggaaaatgtttttctactccaacttgatgaatatgttcaaaagagttgtgaggttagcagatggttctattgttgtaagaccagtaatagaaactggtagatatatgagaaaaactgcatgggataaaaagaaacactttgcgacagttagaaaagtcttgtcataccctcagaacaatatcgtgaagaagacagagattcagacaggtggtttctctaaggaatcaatcttggcgcatggtaactcagataagttgattccaagaaaaacgaaggatatttatttagatcctaagaaatatggaggttttgatagtccgatagtagcttactctgttttagttgtagctgatatcaaaaaaggtaaagcacaaaaactaaaaacagttacggaacttttaggaattaccatcatggagaggtccagatttgagaaaaatccatcagctttccttgaatcaaaaggttatttaaatattagggacgataaattaatgattttaccgaagtatagtctgttcgaattagaaaatgggcgtcgtcgattacttgctagtgctggtgaattacaaaaaggtaacgagctagccttaccaacacaatttatgaagttcttataccttgcaagtcgttataatgagtcaaaaggtaaaccagaggagattgagaagaaacaagaatttgtaaatcaacatgtctcttattttgatgacatccttcaattaattaatgatttttcaaaacgagttattctagcagatgctaatttagagaaaatcaataagctttaccaggataataaggaaaatataccagtagatgaacttgctaataatattatcaatctatttacttttaccagtctaggagctccagcagcttttaaattttttgataaaatagttgatagaaaacgctatacatcaactaaagaagtacttaattctactctaatccatcaatctattactggactttatgaaacacgtattgatttgggtaaattaggagaagattga

SEQ ID NO: 575 - DNA, 4038 bp, S. mutans
atgaaaaaaccttactctattggacttgatattggaaccaattctgttggttgggctgttgtgacagatgactacaaagttcctgctaagaagatgaaggttctgggaaatacagataaaagtcatatcgagaaaaatttgcttggcgctttattatttgatagcgggaatactgcagaagacagacggttaaagagaactgctcgccgtcgttacacacgtcgcagaaatcgtattttatatttgcaagagattttttcagaagaaatgggcaaggtagatgatagtttctttcatcgtttagaggattcttttcttgttactgaggataaacgaggagagcgccatcccatttttgggaatcttgaagaagaagttaagtatcatgaaaattttccaaccatttatcatttgcggcaatatcttgcggataatccagaaaaagttgatttgcgtttagtttatttggctttggcacatataattaagtttagaggtcattttttaattgaaggaaagtttgatacacgcaataatgatgtacaaagactgtttcaagaatttttagcagtctatgataatacttttgagaatagttcgcttcaggagcaaaatgttcaagttgaagaaattctgactgataaaatcagtaaatctgctaagaaagatagagttttgaaactttttcctaatgaaaagtctaatggccgctttgcagaatttctaaaactaattgttggtaatcaagctgattttaaaaagcattttgaattagaagagaaagcaccattgcaattttctaaagatacttatgaagaagagttagaagtactattagctcaaattggagataattacgcagagctctttttatcagcaaagaaactgtatgatagtatccttttatcagggattttaacagttactgatgttggtaccaaagcgcctttatctgcttcgatgattcagcgatataatgaacatcagatggatttagctcagcttaaacaattcattcgtcagaaattatcagataaatataacgaagttttttctgatgtttcaaaagacggctatgcgggttatattgatgggaaaacaaatcaagaagctttttataaataccttaaaggtctattaaataagattgagggaagtggctatttccttgataaaattgagcgtgaagattttctaagaaagcaacgtacctttgacaatggctctattccacatcagattcatcttcaagaaatgcgtgctatcattcgtagacaggctgaattttatccgtttttagcagacaatcaagataggattgagaaattattgactttccgtattccctactatgttggtccattagcgcgcggaaaaagtgattttgcttggttaagtcggaaatcggctgataaaattacaccatggaattttgatgaaatcgttgataaagaatcctctgcagaagcttttatcaatcgtatgacaaattatgatttgtacttgccaaatcaaaaagttcttcctaaacatagtttattatacgaaaaatttactgtttacaatgaattaacaaaggttaaatataaaacagagcaaggaaaaacagcattttttgatgccaatatgaagcaagaaatctttgatggcgtatttaaggtttatcgaaaagtaactaaagataaattaatggatttccttgaaaaagaatttgatgaatttcgtattgttgatttaacaggtctggataaagaaaataaagtatttaacgcttcttatggaacttatcatgatttgtgtaaaattttagataaagattttctcgataattcaaagaatgaaaagattttagaagatattgtgttgaccttaacgttatttgaagatagagaaatgattagaaaacgtctagaaaattacagtgatttattgaccaaagaacaagtgaaaaagctggaaagacgtcattatactggttggggaagattatcagctgagttaattcatggtattcgcaataaagaaagcagaaaaacaattcttgattatctcattgatgatggcaatagcaatcggaactttatgcaactgattaacgatgatgctctttctttcaaagaagagattgctaaggcacaagttattggagaaacagacaatctaaatcaagttgttagtgatattgctggcagccctgctattaaaaaaggaattttacaaagcttgaagattgttgatgagcttgtcaaaattatgggacatcaacctgaaaatatcgtcgtggagatggcgcgtgaaaaccagtttaccaatcagggacgacgaaattcacagcaacgtttgaaaggtttgacagattctattaaagaatttggaagtcaaattcttaaagaacatccggttgagaattcacagttacaaaatgatagattgtttctatattatttacaaaacggcagagatatgtatactggagaagaattggatattgattatctaagccagtatgatatagaccatattatcccgcaagcttttataaaggataattctattgataatagagtattgactagctcaaaggaaaatcgtggaaaatcggatgatgtaccaagtaaagatgttgttcgtaaaatgaaatcctattggagtaagctactttcggcaaagcttattacacaacgtaaatttgataatttgacaaaagctgaacgaggtggattgaccgacgatgataaagctggattcatcaagcgtcaattagtagaaacacgacaaattaccaaacatgtagcacgtattctggacgaacgatttaatacagaaacagatgaaaacaacaagaaaattcgtcaagtaaaaattgtgaccttgaaatcaaatcttgtttccaatttccgtaaagagtttgaactctacaaagtgcgtgaaattaatgactatcatcatgcacatgatgcctatctcaatgctgtaattggaaaggctttactaggtgtttacccacaattggaacctgaatttgtttatggtgattatcctcattttcatggacataaagaaaataaagcaactgctaagaaatttttctattcaaatattatgaacttctttaaaaaagatgatgtccgtactgataaaaatggtgaaattatctggaaaaaagatgagcatatttctaatattaaaaaagtgctttcttatccacaagttaatattgttaagaaagtagaggagcaaacgggaggattttctaaagaatctatcttgccgaaaggtaattctgacaagcttattcctcgaaaaacgaagaaattttattgggataccaagaaatatggaggatttgatagcccgattgttgcttattctattttagttattgctgatattgaaaaaggtaaatctaaaaaattgaaaacagtcaaagccttagttggtgtcactattatggaaaagatgacttttgaaagggatccagttgcttttcttgagcgaaaaggctatcgaaatgttcaagaagaaaatattataaagttaccaaaatatagtttatttaaactagaaaacggacgaaaaaggctattggcaagtgctagggaacttcaaaagggaaatgaaatcgttttgccaaatcatttaggaaccttgctttatcacgctaaaaatattcataaagttgatgaaccaaagcatttggactatgttgataaacataaagatgaatttaaggagttgctagatgttgtgtcaaacttttctaaaaaatatactttagcagaaggaaatttagaaaaaatcaaagaattatatgcacaaaataatggtgaagatcttaaagaattagcaagttcatttatcaacttattaacatttactgctataggagcaccggctacttttaaattctttgataaaaatattgatcgaaaacgatatacttcaactactgaaattctcaacgctaccctcatccaccaatccatcaccggtctttatgaaacgcggattgatctcaataagttaggaggagactaa

SEQ ID NO: 576 - DNA, 34 bp, Artificial Sequence
  synthesized sequence
gaagttcctattctctagaaagtataggaacttc

SEQ ID NO: 577 - DNA, 30 bp, Artificial Sequence
  synthesized sequence
agttcctattcttcaaaaggtataggaact

SEQ ID NO: 578 - DNA, 30 bp, Artificial Sequence
  synthesized sequence
agttcctattcttcaaaaagtataggaact

SEQ ID NO: 579 - DNA, 30 bp, Artificial Sequence
  synthesized sequence
agttcctatactctatgtagaataggaact

SEQ ID NO: 580 - DNA, 30 bp, Artificial Sequence
  synthesized sequence
agttcctatactttctggagaataggaact

That which is claimed:

1. A maize plant, maize plant part or maize seed having in its genome a genomic window comprising at least one heterologous sequence integrated into at least one Cas endonuclease target site, wherein the Cas endonuclease target site selected from the group consisting of SEQ ID NOs: 3-5, and 7-11, wherein said genomic window is flanked by two sequences, wherein the two sequences correspond to SEQ ID NO:1 and SEQ ID NO:12 as provided in a B73 maize plant, wherein said genomic window comprises a first recombination site and a second recombination site, wherein said first and said second recombination sites are dissimilar with respect to one another.

2. The maize plant, maize plant part or maize seed of claim 1, wherein said genomic window further comprises a transgene.

3. The maize plant, maize plant part or maize seed of claim 2, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

4. The maize plant, maize plant part or maize seed of claim 1, wherein said genomic window further comprises at least a 1st, 2nd, 3rd, 4th, 5th, 6th, 7th, 8th, 9th, 10th, 11th, 12th, 13th, 14th, 15th, 16th, 17th, 18th, 19th, 20th, 21st, 22nd, 23rd, 24th, 25th, 26th, 27th, 28th, 29th, 30th or 31st transgenic target site for site specific integration integrated into at least a 2nd, 3rd, 4th, 5th, 6th, 7th, 8th, 9th, 10th, 11th, 12th, 13th, 14th, 15th, 16th, 17th, 18th, 19th, 20th, 21st, 22nd, 23rd, 24th, 25th, 26th, 27th, 28th, 29th, 30th or 31st double-strand-break target site.

5. The maize plant, maize plant part or maize seed of claim 4, wherein said at least 2nd, 3rd, 4th, 5th, 6th, 7th, 8th, 9th, 10th, 11th, 12th, 13th, 14th, 15th, 16th, 17th, 18th, 19th, 20th, 21st, 22nd, 23rd, 24th, 25th, 26th, 27th, 28th, 29th, 30th or 31st double-strand-break target site is a Cas9 endonuclease target site.

6. The maize plant, maize plant part or maize seed of claim 4 wherein said at least one transgenic target site for site specific integration further comprises a polynucleotide of interest flanked by said first recombination site and said second recombination site.

7. The maize plant, maize plant part or maize seed of claim 1, wherein said first and second recombination sites comprise a FLP Recognition Target (FRT) site or a mutant FRT site.

8. The maize plant, maize plant part or maize seed of claim 1 wherein said first recombination site and said second recombination site is selected from the group consisting of SEQ ID Nos:576-580.

9. The maize plant, maize plant part or maize seed of claim 1, wherein said genomic window further comprises a transgenic target site for site specific integration located outside a Cas9 endonuclease target site.

10. A maize plant, maize plant part or maize seed having in its genome a genomic window comprising at least one Cas endonuclease target site, wherein the Cas endonuclease target site selected from the group consisting of SEQ ID NOs: 3-5, and 7-11, wherein said genomic window is flanked by two sequences, wherein the two sequences correspond SEQ ID NO:1 and SEQ ID NO:12 as provided in a B73 maize plant; wherein said genomic window comprises a transgene.

11. The maize plant, part or maize seed of claim 10, wherein the transgene confers a trait selected from the group consisting of herbicide tolerance, insect resistance, disease resistance, male sterility, site-specific recombination, abiotic stress tolerance, altered phosphorus, altered antioxidants, altered fatty acids, altered essential amino acids, altered carbohydrates, herbicide tolerance, insect resistance and disease resistance.

12. The maize plant, maize plant part or maize seed of claim 10, wherein said genomic window further comprises at least a 2nd, 3rd, 4th, 5th, 6th, 7th, 8th, 9th, 10th, 11th, 12th, 13th, 14th, 15th, 16th, 17th, 18th, 19th, 20th, 21st, 22nd, 23rd, 24th, 25th, 26th, 27th, 28th, 29th, 30th or 31st double-strand-break target site.

13. The maize plant, maize plant part or maize seed of claim 12, wherein said at least a 2nd, 3rd, 4th, 5th, 6th, 7th, 8th, 9th, 10th, 11th, 12th, 13th, 14th, 15th, 16th, 17th, 18th, 19th, 20th, 21st, 22nd, 23rd, 24th, 25th, 26th, 27th, 28th, 29th, 30th or 31st double-strand-break target site is a Cas9 endonuclease target site.

14. The maize plant, maize plant part or maize seed of claim 10, wherein said genomic window further comprises at least one transgenic target site for site-specific integration, wherein said transgenic target site comprises a first recombination site and a second recombination site, wherein said first and said second recombination site are dissimilar with respect to one another.

15. The maize plant, maize plant part or maize seed of claim 14, wherein the dissimilar recombination sites of said at least one transgenic target site for site specific integration comprises a FRT site or a mutant FRT site.

16. The maize plant part or maize seed of claim 15, wherein said first recombination site and said second recombination site are selected from the group consisting of SEQ ID NOs:576-580.

17. A maize plant, maize plant part or maize seed having in its genome a genomic window comprising at least one altered Cas endonuclease target site, wherein the Cas endonuclease target site selected from the group consisting of SEQ ID NOs: 3-5, and 7-11, wherein said genomic window is flanked by two sequences, wherein the two sequences correspond to SEQ ID NO:1 and SEQ ID NO:12 as provided in a B73 maize plant, wherein the altered Cas endonuclease target site comprises an insertion, deletion, substitution, or a combination thereof of at least one nucleotide, as compared to a non-altered double-strand break target site.

18. The maize plant, maize plant part or maize seed of claim 17, wherein said altered Cas endonuclease target site comprises a polynucleotide of interest.

19. The maize plant, maize plant part or maize seed of claim 18, wherein said polynucleotide of interest comprises a transgene, a native gene, an edited gene, or any combination thereof.

20. The maize plant, maize plant part or maize seed of claim 17, wherein said genomic window further comprises at least a 2nd, 3rd, 4th, 5th, 6th, 7th, 8th, 9th, 10th, 11th, 12th, 13th, 14th, 15th, 16th, 17th, 18th, 19th, 20th, 21st, 22nd, 23rd, 24th, 25th, 26th, 27th, 28th, 29th, 30th or 31st double-strand-break target site.

21. The maize plant, maize plant part or maize seed of claim 20, wherein said at least a 2nd, 3rd, 4th, 5th, 6th, 7th, 8th, 9th, 10th, 11th, 12th, 13th, 14th, 15th, 16th, 17th, 18th, 19th, 20th, 21st, 22nd, 23rd, 24th, 25th, 26th, 27th, 28th, 29th, 30th or 31st double-strand-break target site is a Cas9 endonuclease target site.

22. The maize plant, maize plant part or maize seed of claim 21, wherein the polynucleotide of interest confers a trait comprising male sterility, site-specific recombination, abiotic stress tolerance, altered phosphorus, altered antioxidants, altered fatty acids, altered essential amino acids, altered carbohydrates, herbicide tolerance, insect resistance or disease resistance.

23. The maize plant, maize plant part or maize seed of claim 17, wherein said genomic window further comprises at least one transgenic target site for site-specific integration comprising a first recombination site and a second recombination site, wherein said first and said second recombination site are dissimilar with respect to one another.

24. The maize plant, maize plant part or maize seed of claim 23 wherein the dissimilar recombination sites of said at least one transgenic target site for site specific integration comprises a FRT site or a mutant FRT site.

25. The maize plant, maize plant part or maize seed of claim 23, wherein the first recombination site and second recombination site are selected from the group consisting of SEQ ID NOs:576-580.

* * * * *